United States Patent 11,339,436 (METHODS FOR EARLY IDENTIFICATION OF BONE HEALING ABILITY IN INJURED PATIENTS) - sequence listing, part 2

SEQ ID NO: 1190 - RNA, 11930 nt, Homo Sapiens
gagaacaagcuuuagagaugauaaaagcacaguaucuuggcaaccuuuuguguuggguuauuuuuaaaaaauggauaauauugugcucuaguucucauuuauucagcuacuugcugagugauagcaacauuacaacuacagaaccuguaugucaucuugacauuaagcggccucggggagcagcccgaggcugcgcgugggcuccgcuccuccggcgaggugugggcgaggggagcggcgcuccgagcgcacccaggcgcccgacgccgcccgggucugcgccgcugcuagugccaggcgggcgacgaucguuuucccccuccuccucuuccuccuccuccucuuccuccuccuccgcccaucaccgccacuacgaacgccuucgccuccuucuacaccucgcgccgccgccgcggcuccuagcgcuccucuccggcuuccaccagcccaucgcuccacgcucucuuggcugcugcagucucggucucucucucucucucucucucucucucucucucucucucucucucucucucucucucucccaaguuuccuaucucgucaagaucagggcaaaaggaagaaaacaccgaauucugcuugccguuucagauuugcaacuacaauaaaauccaggacaccugcucggcagcacguuagccuggcucuuuuauagucuucaacuuugcucacugugauuaccgcugccugccuggcugguguuugcugccggagccucacgcgccuucucuuauugugauccucggcuccagagcagcugucaaacgcgucguuucgcagcacuugaucggaacccggcugccucuaagacuuggucuugggcaaccgugggugggcaggaagggaaauuauuuauuuuauuuuguuaaggggagugaagaaaagaagacgugaggaccgcaguucacuguaauguagaguaauugcaaaagugggcugccugccccuagcuuuucccgcugugguugcggagguggucuugguugaggggguuguggcgugaaguacccaucucuccucuccucuccuuuccuccccuccccuccaacccauucccuuuccagcugcuaugccaguuuaaaguccaggguguuauuauuacgugugcgcaaaacaguguuugcugacgaugaggcugggggacguuccuggcagagagaagucugauuacuuggucaucuugcuguuaaagaaagaaagaaagaaaaaaagaaagaaagaaacagaaaggaaaaggguggggguggggguccauaaaaaagaaaucgucucucaaucaucaaguccuacacagaguccaggaaguaaucuccauagcuuuaacacgaaucccuaacuaaaaggauauucuuugggguuacuuggauagugaaacugaaggcaauuuuaaguguauuuuguuuuucauuccauggcuuuguaaagagcggcggugaugaagacaaaauugaacaucuacaacaugcaguuccugcuuuuuguuuucuuggugugggacccugccagagaccaaucaggaagaacuaggcucuaaggaucucugcagcuguguauguguugcugaugcuuucagagcccaccuccaccuccuggcuacauggagccuggcacauagccaguggaguuucccugaugcuuauauugcacuuggccauuggguggagguauacccaaaguuggugcuggcuaacauccaagaagaugaggcuaaaaauaacauuaccaucuuuacgagaauucuugacagacuucuggaugguuacgauaaucggcuuagaccaggacugggaguuuccagaguggaaucuccagucuguguaacauagccuucaagagccagaacaaagggacccaaacucaaaugcucuccaugggcagaacaaauaaaggaaugaguggagcauaauggagauugaagaacuggagagcacauuucuuguaugaaggggguugaguuuuaucugaucauugccacauaaguauuuaaaaucagaguugccagauauuccaauuauuuuucaaaaguuguugaagaucuccauuuuuauagaaaguuuucuucagucuuaaaggucaaccaauuuucauuuaaaucaaacuaaacaaaaucugugcuucccaaacaaaucacacuugaguauuaguuugcagccucuggcccuaaaccaagacuucucauaaaggguaugaaaaaaccagucggaaaacuuguuaagugcaaauuuaacaaaucuucaaagacucauucagauuugguuuggucccagaacuauauuucaacaaauguucuugauucugaugcacaugguccaaacacuggacugagucaucuguuuucaagguucugguuaaaaaugaugguuucuuucuucuuucucucauaguacuuuauuugaacucuuuuaaguuaaagggaaaaagaaauguguaugguaagauuggucuguuaccagaugagucuagcuagcauuuuccucaaaaccucaaagagaggccucugucccccauuguucugagguggcugucaguguuacaaggucagaguccuacuuuuguuuagugauuggauuagucagaauuaacuggcuuauguuucaguaauaacuauccaguuuuaucucucgaucauguaucuugcucacgauccaaccuuguccacugagguuggauggcauguaggaaugggcucucuuuuaugucuuccucacuuaggguuucggauugauggacuuccaccaccuaaaacauugcuagccacuguguccaggggaaagauguggcuagguguacacugucauuuaaagcuucugcccagaugugacacaaugucccucugcccacaguccauuguucaaaggaaaccauauacacauguuuaacuucaagguggcagggaagugcaacccuaccauuuacucagaaguggaagaacuagcaauauuuugcaaguaacuuaauaacuaccacacuuggcaaguagaacccauuucucagggugcaagucaucuuccauagugacugauuauacaaacuguuuggugacacaggucauaucucauuucaagauguauaauucugcaacuuuguuuugucuguagcaugcauagaauguuuaugaaguuaauuauuaugaagauaugauauuaauaaccaugcuuuuuuggauauagucaacuuuauguaccuucucuuuucuugguguuagaaggcagugcuguaugcccuuuuuccaaagcucccaggaauaaagagguuugccauuugugcugugaaggcauaguuccaguugaagauauuuaaaaagagauacucuuugaaguguuagucugaaauuucaaccuccgugacaguaauugccagggagaauggaguuagauaggugaggaagagaccaugugugguuugcuacuguguccuuagugcuuggcacaguauguagaauucaccauuugucaauugauuaugugaauccaacacucauauaugcaaaaacagacauaucugugcuuuggagagcuacuuauuuuggguucuuagaaauguuuuugacauucaacaaucaauuuuuuucuauauauuuuagugguuuagacuucugacauugcuaacaacgagucauccuucucagaaacaauguugauugauagauggguuaaauuggucugcugaaccuuaaauucaguagcacauaaaauuagaaccauuggguugaaccuggauuuaauauagugaaauggacuaauucaguagccccugcuguuacugcuuuucagaccaucugagcagugaucaugaacaaaggcucuauggcuucagucaucuguaaugcauacaacacugccuucuaaccccacaacaaaagcuuuggaagagccacuagaugcacaugauagagacaaaaacaagaacuacaaaaauguauuuuaaaagccugaaaagcauaagccuaaaaugucucuguauuuugagauuuugcaaaacuauuguuaguuuuauaccaaccguuuaaaguuuuucaguugucuugcagaggcuguuaaugaaaaguuauaagauaauggaaucauacuaaauuauaauuucuaacagguucugagauugaggugccaugcuaagcacuuuacauaucauuuaauacucauuauaacucccaugagauagauaaauugaugaccccuaccuuagaagcaaggaaaugagagccgcagaccaauuacuugccuuuugucaccuaauuauuuugugauggcauggauauucuauccaauauaauuuucucaagagccuuucuccagagucucaucaaucaggaauuaagcacccucaaaucaaacaaaggugguaucaaugaguauauguaugcuuuggaggaggagcucacuauuuguuacauuuguguaaucauuagcaucuggauaaguaucucuggaaggggaaggauggugcgcaguuucauucuuuuauuuguuuagguguucuuauuauugcauuucuuggucauccugaguuugacguauauccagacuugaauacagguuuagacaugaaggaucagaaaggacagugcaguguuuagcagaaaaucuauuaggguguugugaauuaaagccagaaucuguuacucucacugcugauuuuacucccuuacugugugaaucagagcuuuugguauuauuaugcuggagaauagcuaaugagaaggagauaagaagaccauguagucuagauagauaaucucagcauuucuugguacaaaguacauugguacuugaguuauuuguaaaauuaguaauacaaugaugcaauuguucauauaaauuucaaucauguuaagcuuauuauaagugauauugaaguaauaugauacaugaagaagggaugaguauaugaaaggcaaauagaugaaggcauauuaaaugcaagaacccucuuuccagaugcauugaguuacaacugcuucauuucccuuuguucccauuugacccauguacaucuuaugagacacaauauaguguacuuuggaaaagaucaggcuuuggagcuugaaaaaccaggguuuguauucugguuugagcauguucuuaccaugugcuuuuuguauacaugaauugccuucucuaaaccucaguuucuucaucaguaaaauaaguauaaaauaacuaacauuuauagcaagguuacaaagaguaaugaaauuauuuguaauguuccuguaaaaguacccagcauauguuggguguucauuaguggccaacuucccaugugccuuuugauuuuugcgaacaugucauaauguggagauuuguucacaauuuaggaaauaaugagugaaaaugagagaacaucuaaaaauaggacaugagauaguuauuuuuacuaagagaguucauggaguuugauagucuuuauuuaacuguguauccuaggguuacaugugauuaaauuuuuccuuugugggaugcccuuuaaguagaaguuuauugcaaaauucuccauagaauguuuaaauuucaugguauuucuugucauacacuagaauuaaaugagaaggaauaguuggauuuugagauuacaucuauggaaguacagaaccaaacaggagaauaagguguuucugagaaaaccugagcagucaaauaaaugauagcuuaacuucaucuggcuuuucuuuagaaauuuagacuuccauaaauauguuguauuucccuugcauaaauauuagccauuagugaucuaauuaccuguuagauuucuaaucaugauuacuuaugauuucuucaaaacuuaaaaaagguaaccuuuuaaaaugauugaaaguguuaugcaauagacaauuuuuaaaacauuuacugaaaugaguaggagauagaauucuaggcuauccccaaauuucuugucacauguuuuacaugcccuguaugauuucugugacugugacugugauuucagucugaugauuaguuuuuguuauauggcacaguugacuuuaagaaagggacauuauccgagugggucugaccuaaucacaugagccuuuuaaaucuaaaucaagagaucagagacagaaaaguccaggauauuuaaaacaugagggagauucuucauugcugguagggggccacauggcaaggaacacaacagccucuaggagaugagacuugacagccagcagggaaaaugggaaucuuaauucuacagcugcaaggaacuagauuuggacaacaaucugaaagagcuuagaagcugauucuuccccagaggcuccagaaaggagcacagcacacccauaccuugauuucagccaugugagaaucugagcagagaaccaagacauagcaugcuggacuucugaccuacagaacuaugugcuaauaaauggguauugucuuacauuguuaaguuuguaauaauuuguuaaacaauagaaaacuagcauaucuacuguuacuaauuuuuuaaaauacauuuuucaguguuuaaccugugcuaggcauaguguacuuuacaccuaccaucucauuuaauuauuucaaaguacuguaagauaggcauuauaagccacauuuaacagauaagaauaucgaagcacauauaaguuaaguaauaugcauagggucacaaauuauuaguguauaacucugaauugaauuuagaucucuuugauuccaaggcuugggaucuuacaugccccuuuauuagguaggaauagauacuucaugaagaugauaacaugccaucuacagaauacgauauggcauugaugugacacuuuaccuacaaaauaucuuauuucugagucuuccgcaagagaaaaagcaauuuuauuuuuaugggacaagauuggauguuacauuuuuaaucaauuacauguaaguguauucuaccuuuaaaauugcuauggaaaaguuuaauuauuuccaacaggauuuauaacuaucaguuauaccucaaaguuguuauuaacugaauaaaacuacacauuccaaaaugauuaacucuuaaagcgcauuauugguacauucauaauguuuaauuuuauuuuuaucauccuugcucauauugaauaaaugccuuuuaaaaccaacaguauuacugaagucuucacuaacaucuacgugaccaguuuuggcccugucucagauacagauauggaauauacaauugauguuuucuuucgacaaaaauggaaagaugaacguuuaaaauuuaaagguccuaugaauauccuucgacuaaacaauuuaauggcuagcaaaaucuggacuccagauaccuuuuuucacaaugggaaaaaaucaguagcucauaauaugacaaugccaaauaaguugcuucgaauucaggaugaugggacucugcuguauaccaugaggcuuacaguucaagcugaaugcccaaugcacuuggaggauuucccaauggaugcucauucauguccucugaaauuuggcagcuaugcauauacaacuucagaggucacuuauauuuggacuuacaaugcaucugauucaguacagguugcuccugauggcucuagguuaaaucaauaugaccugcugggccaaucaaucggaaaggagacaauuaaauccaguacaggugaauauacuguaaugacagcucauuuccaccugaaaagaaaaauuggguauuuugugauucaaaccuaucugccuugcaucaugacugucauucucucccaaguuucauucuggcuuaacagagaaucugugccugcaagaacuguguuuggugagugaauacacacuuugcaguacagcacauuauguuucauagcauacuuucaaaaacauuaucucucuugauccucaaacuaauuauuuguaguagguggggcggggaguauuguuuuugccuuauaggugaagaaguaggcucagagugguaacauagugcuacacuguuaauaagggauauaaggaaagaaaaguacucaaauauucuuaaaacacacuuagucuucuuucuguuaaaucauacugcuguucaacauuugucuguacuauauuuacacaaggagaauuuucuuagaaguuuuaauuuauagucucacuaccauauuucuaggcuuucuauauuuuucuguuguuuuuagaugaagagugaugaucuuaaaacuuuaaguuagaaacagguagaaagggagggaggaagagagaccucauucacuuuugaguaacaacuguccuaacaaugacaacucuaagcaucagugcucggaauucucuccccaaaguggcuuaugcaacugccauggacugguuuauugcuguuuguuaugcauuuguguucucugcccuaauugaauuugcaacuguuaauuacuucaccaaaagaggaugggcuugggaugggaagaguguaguaaaugacaagguaagugagagcuuccguguuaucauuauuaagaaaauacccuaaugaauuccgcuuguaacagauauguuucuaaaaacugacauuaaagacauccauauauauaugaauuugaaucauaucaauuucuuuuaaaguguucuugccugaaauccuuuaggaguucuuguaguacuaauacuuccauuaaaaccacuccguagcaucuguugagcuguaugugucaggcacugugcuaaguguuuuacauaugcucucucacauaaucuuuauagcauccuuaugacuagacugccuucuuauucuuauuuuuacucaugaagaaucugaagcaguaaaguuauuuucuugcccaagcuuacacaacuuguuaguaaguauacuugaacuccgaucuaccugucugacuguuaaguucaugguuuuaacaccacacugcauuauuauaaagagauuagaaaaagaaaaugggcauuaauuuuacuuauuauagaauuccaggcucuaucaaugaauugaauccucuucaccuguuccagucucugcugauugauuguaaaagcccggauagcauuuuuuuaaaaucuuucccauguuguauggaauaaauaugucggugcuggaaugcuuaggaauuuuaaauuguucauauggucuaaaagggaaaaguuauuuguuuuuaagauuaacuucuuuugagauuauugcuguccauauuuagguuucaaguacugaaucuaaugggagauuugugcauugauauaacagcuguuuccuuucauacucuguagauuauguaucugccuaagaggaggcuuugaauguaucauaaucaucuauauucuuaauaaugguaaaaaguuguauucagaggauaucuuuaacauuguaucaaccuaaaugcuucuuuuauuaaauuuggauuaacauacuugcagauuugauuucuuuuucaguuauuugaauauauuuuuucauuucuaugaccauguuacaguuuaaauauacaagcaguaaauguuauaguuuaaaagucuuggucuuuuuccuuaauuuuguaagccauagaaauuuuaauaagacugauuauuuauuucauuuuauaaguuguguuuucccuacuaacggagccaacaaauaaauauuaaaaggaauccccuucaauaaaagcugaaggcauuacauuaacauacaacucagugaaagcaauucuucaaggagcuaagcuaauaugguccaaguauauagcuuucucauggcccaguuuauuccaagaaaagacuuuagaguacuuagagaaguggauggacuguuuaaccuucaaacaaucuucuaaaaaagaaaaggcuuccguuaugauacagaacaacgcuuaugcaguggcuguugccaauuaugccccgaaucuuucaaaagauccaguucucuccaccaucuccaagagugcaaccacgccagaacccaacaagaagccagaaaacaagccagcugaagcaaagaaaacuuucaacaguguuagcaaaauugacagaauguccagaauaguuuuuccaguuuuguuugguaccuuuaauuuaguuuacugggcuacauauuuaaacagagaaccuguauuaggggucaguccuugaauugagacccauguuaucuuugggauguauagcaacauuaaauuugguuuguuuugcuauguacagucugacuaauaacugcuaauuugugauccaacauguacaguauguauauagugacauagcuuaccaguagaccuuuaauggagacaugcauuugcuaacucauggaacugcagacagaaagcacuccaugcgaaaacagccauugccuuuuuuaaagauuuacccuaggaccugauuuaaagugaauuucaagugaccugauuaauuuccuauucuuccaaaugagaugaaaauggggauccuguacaacccuuuguggacccuuuugguuuagcucuuaaguagggguauuuucuacuguugcuuaauuaugauggaagauaacauugucauuccuagaugaauccuuugaaguaacaaacauuguaucugacaucagcucuguucaugagugcucagagucccugcuaauguaauuggaagcuugguacacauaagaaaaacuagagauuugaaaucagcuaugaauuacucuauauaguaucuauagccauguacauauuacagcaugacaagcucaaauaauuaugagucagcccgaaaggauguuaauuaugccuacgauguaauaacuauuggaaugucauggucauuacauuuuuagcuucagaguuuauuugaaaguaauaauugaaauccuacaauuuauuuuaaucauuggaaacuaccuuaauuaaaaaaaaagaaaagaaaugugucuuaacauuuccagguauguguuguauugaaauugaucagcuaaauuuuacgggugcuggagacuggaaaaagcauccaguuugguugcuguggagcaacaugcauauuggauuagaaaauugugccaaaaacucccacugaugagaauucauaggugccccacacuaugacaaacacuuauaugauucuccucuuuccuguuuacugcaaauucugccuuaaggcuucuuuucaagacucagaagccacuaauuauaaaggaaagggcaguuaauuggcacauuuuucucuugugaaagcaguucuuucagauaagaauuaauguaaaucugcuuuuguaaauugcaacuuuaaauuucgcugacucaaauuuacaacagcuuuguauaccagaagagguuuugguaaggguugaacauuuuuacacugcaacuuuaaaacaucaccaauagauuguggauuauuucacgugcacaaacauacacacacacacacacacacacacacauacacagcuaaauuagaaaacacaauuuuaaauuuuauauaauuacuaguuauuaauggguaaaauucauuuuucuuuuaauaucuuaaaauauuauuuaugccccgaaauaugcuaauaaaaguuaaagauuguguauuaugccuagauucaaaguuuuuggcaaacuucaaauacuuuugauugacauguacauuagcaguuauuaguugacuuuuacuaaaacaugcaccuuuacgaugguguuuuuguagaaacauaaguagucaaauaguaacauuuauugcaguuuuguacaguauuugaguauagugcauaaauagguauguucauaaaaucaauaaaaggaguaucuauggaaauaagcaaaauaucagcaaaaauugcuauuccuuugccucauuuaauuuuuaaaauuucuuuguuuccaugugauucuauuauaugcuuugcaugcuuguauaaaaccaaggucacaaaugcaacuuauuaacggaauuugccaagaagacagccuugacauuaaaaauucccucacaagagguaauccauaauccuuaauaaaauaaaauuguuacaugagccaauaaauguauuucuuuaauucc

SEQ ID NO: 1191 - RNA, 10087 nt, Homo Sapiens
agagcagacaaaauauggggccccuggcgcuuaaaguucaguuugucucucuugagcuuggagaaaaucauccguagugccuccccgggggacacguagaggagagaaaagcgaccaagauaaaaguggacagaagaauaagcgagacuuuuuauccaugaaacagucuccugcccucgcuccggaagagcgcugccgcagagccggguccccaaagccgacacuggcggcaggggaggcugcagguggagcugucggagccagccccucggggaucuacagcuuccugucugcgccggcgucucgggcgccggguggcuggagggacugugcagcagucuugccugccccagacgucuugagagcugaugacaauaacaugggcaauggcugcucucagaagcuggcgacugcuaaccuccuccgguuccuauugcugguccugauuccauguaucugugcucucguucucuugcuggugauccugcuuuccuauguuguuuuacuuggcugucucaccacagccagccccaugaagaggaacauuacaaaaggucuauuuuaaaucaaaugggagugaaccuuuggucacugauggugaaauccaaggguccgauguuauucuuacaaauacaauuuauaaccagagcacuguggugucuacugcacaucccgaccaacacguuccagccuggacuacggaugcuucucucccaggggaccaaagucacaggaauacaaggugccuguaugaacaucacccacagccagugucagaugcugcccuaccacgccacgcugacaccucuccucucaguugucagaaacauggaaauggaaaaguuccucaaguuuuucacauaucuccaucgccucaguugcuaucaacauaucaugcuguuuggcuguacccucgccuucccugagugcaucauugauggcgaugacagucauggacuccugcccuguagguccuucugugaggcugcaaaagaaggcugugaaucaguccuggggauggugaauuacuccuggccggauuuccucagaugcucccaguuuagaaaccaaacugaaagcagcaaugucagcagaauuugcuucucaccucagcaggaaaacggaaagcaauugcucuguggaaggggugagaacuuucugugugccaguggaaucugcauccccgggaaacugcaauguaauggcuacaacgacugugacgacuggagugacgaggcucauugcaacugcagcgagaaucuguuucacugucacacaggcaagugccuuaauuacagccuugugugugauggauaugaugacuguggggauuugagugaugagcaaaacugugguaaguagcauuguuuccccaaagguuuuaauuuaaaaucauagaaauuuauaaccaaaaacuuacaguucauuauguguuaauaugauuagcaguuuaaauuacaaaaugauugguuucuuguuuuuuagaaggaggaaguuuguucagucacuguccucaguaaugucuuauguguaaauguaauaccuaaaaaaucauauuaagaaaauguuuaagaagugggaugggaagacugguaaagguuguuaaugcauuaauaguuuuuuuuccucuccucaaauguguucuguuucuccucugguuagagccaguggcuuacguuagauuugggcuuuugagcaaacuuugagggcagauauauugucugugccugauucccuugguacaugugacugaaguccccuccuuuauuuaauccucaaauaguacagggaccaccuguucagcagcuacacccaggguuaggaugaugcauuuguuuuguguacacauggugaucuuaucuuuuaaagaauaaccccacuuuuuaaagagucauguccaauucugaaugccaucucaugaauuaaaaucagcaaaauuccucuugcucauuuacuuuuuuggcuuugugacuagcuucagaauuuuuagguagcauauuauugagugacguaggaacuuugcaacaugaacaaaagggcaaacugggaugaggauacacccuggacaaaugauaucagacaauguccugcauuagauaacaucaaaaugaauguuugggaaggaucagcgguauggucagaggaaggcauuggaaucaugaauguuaggaauaaccccaugcugggaaaccuggugguuucuaggagcgcugucuagcugccacuugcuguaucuguaaaaauauuuuaaaauguauguguacaaaccauuccugugugacuagauagagguggguuauugcuuuuuucugauaauaguuuauuuuuauuuuauuuugacuaauaauaguuguacauauuuauugaauacagcaugauauuuuaauacauguauacaauauguaaugaucaaaucaggguaauuaguguauccaucaccucaaacauuuaucauuucuuuguauuaggaacauucagaaucuucucauuuaguuauuugaaaauaugcaauaaauuaucauuaacuauagucaccauccagugcuauaaaaaccuacaacuuguuccuccuaucuagcuguaauuuuguaucaguuaaacaaucucugucucucucucucuuuuuuuuuuuuuuuuuuuuuugagauggagucuugcuccaucacccaggcuggagugcaguggcgcuaucccggcucacugcaaucuccgccucccgggcucaagugauucuccugccucagccuccugaguacuugggacuacaggugugugccaccacgcucagcuaauuuuuguauuuuuaguagagaugggguuucuucauguuggucaggcuggucucuaacuccugagcucaugauuugccugccucggccucccaaagugcugggauuacaggcaugagccaccgcaccuggcagcaaucucucuuugucccuccuccuccauacccuucuggccucuaguaaccacuguucuacucucuauuuccaugagaucaacucugcauaugagugagggcaugugguauuucuguuucuaugccuggcuuauuucacuaaacagaauguccuccaggcucauccauguugcuacaaauaacaggauuuuauucuuuuggcguggcugaauaguauuccauuguguagauguaccauauuuucuucuccacucauuuuuugauggcauaaauugauuccauaucaugguuauugugaguagugcugcagugaaugugggggugcagaugucuguuugauauacugauuuccuuuccuuuggguauaugcccaguagugggauugcuggguuauauggaaguucuauuuguaguuuucucaagaaccuccauauuguuuuccauaaugacuauacuaauuuacauuuagauguggguuauauccugggacugacuagucuugagaaaaaggaugagaggaaauuguaauuauauagaucacagaaauuauaguugcaggaggccuuggagaucaucagauucaacccuucccuuuaccagugagauaauuaggaaaugcaggggauugaaaaugagugagugucguuugguaguuggauagguuaguggagagggccagcaugcagguagcaugugagaaaaaauggucuuaacaggcaacagaauuccucugaagauagcaggcuaucaugaaguuugugugucuggaugccaguugucuccaucuaauagcaauaauuaucacuuuccuucagaccagccucugcccuggcucccugugcucuucugguuccugcccaagcacuucuuaugcuuuucuucuuuucucaaaccuauguccucccuauacuuuccucuguugauccaaaauaugcuuuaagauccauggucacuccggaagucugucuaugaccauggcacuguuacuagacucaucauacuuucucauggaaucuauuauucaugaauccacauacaucuucuaaaacacugcuuauauucaggguauaccaccucucauggcaaagcauccuauggauucugcccuuugugagagcgaacuuaucacuuaguucuuuuucacuaauauauaaauugggacaaaguugaaguccaggcuaaaaagaaucaugaauauaacauaaauauuuugcauggcuuaccuagcaguucuuuuggauauaaggccaggcaugcuggcauauuccuuguagucccaacuacuuggaggcuggggugggaggaucaccugauccuaggagguugaggcugcagugagcuaugaucacaccacugcacuccagccugggagaaagagagagaccuugucucaaaaaaaagauaaucaauuaaaaacuuaagcuuagcaucaggagagaugacaaggagauacgugccuucccaauuugccagacagguaaguuauaauuccuagaaacgugagagagcuguuacagauacaucaaauccgcuagccgcauugugaaacacaaaucacaguucuguuuuuugaaccaggguagaaaucauaaauuuuucauaaggaaagaaaaugacaacuaaagaaaacaaaagccaacaacaauaagaacaaacuacggguccuggggcagcuagaguaguuacuuaucugaaaaacagacccaucuuaccccacagugaugguggucaguggggcacaugaguggggagggcguggcauuuuaauugggccagaccuauuguagaaauguuauugaagguauuggagccauuggaacagacucucuucgaugggaacugggagccauagaauccugccuguuagucaugcugguucucugcauccucgugaguuuucauuucuccagauugcaaucccacaacagagcaucgcugcggggacgggcgcugcaucgccauggagugggugugugauggugaccacgacuguguggauaagucugacgaggucaacugcugugagugcucugaggacguuuguuuugcuuauuuuuccauuucugguucuuuaggcuguacucaagguugaggacuguacuuaagacucacuauauacacagcauuccaagggaaagauucuuaugcuuugguucuagccuguaaagaucacugagucaugggaugacaauagcaauggaguguaucugacuuccacaccucucccugcaaaacuccaagcuucauuuggcugaucuagccaagugggugucuguuuucucucucguugcuccauaugucucuuuuaugcuucugugacuuugucaaaggugaugcucugcccacagaauggggaaccuuucuucugcaaacaauacaugaguaguuaagcuucccugcaggagugcccuaacauguuuucaggggccauuuguggaagaacauggaaagaaucgucagagagaagagagccuuuaauguucauaugaugauacaaagagagcauaauaggccgggcaugguggcucacgccuguagucccagcacuuugggaggcagagauggguagaugaccugaggucaggaguuugagaccagccuggccaacagucucuaguaaaaauacaaaaaccugucacagccagggucugguggaaugcagaaauggacaauguauccccagcacguuucaaugugauggugacgaggacugcaaggaugggagugaugaggagaacugcagcgucauucagacuucaugucaagaaggagaccaaagaugccucuacaaucccugccuugauucauguggugguagcucucucugugacccgaacaacagucugaauaacuguagucaaugugaaccaauuacauuggaacucugcaugaauuugcccuacaacaguacaaguuauccaaauuauuuuggccacaggacucaaaaggaagcauccaucagcugggagucuucucuuuucccugcacuuguucaaaccaacuguuauaaauaccucauguucuuuucuugcaccauuuugguaccaaaaugugaugugaauacaggcgagcauaucccuccuugcagcuagggcauugugugaacacucuaaagaacgcugugagucuguucuugggauugugggccuacaguggccugaagacacagauugcagucaauuuccagaggaaaauucagacaaucaaaccugccugaugccugaugaauauguggaagguuaauuuuaaaauuaauuacagcaggguaucuaacauggaugaacauguuagcuaccuuuugaauuucuucuauuuauggcuucuuguuuguuuguuuucuauuuaguuuccaaucaggcugcuuaggugagugaauuugugaacuugauugcauugaagaauuuggcacucaucuguuagauauugcauucauuuuaaaaauaaagaagucauuuucuauuaaugcucaccuagucauuucaagugccgcucaggacaguguguucuggcuuccagaagaugugauggccaggccgacugugacgaugacagugaugaggaaaacugugguuguaaagagagagaucuuugggaauguccauccaauaaacaauguuugaagcacacagugaucugcgauggguucccagacugcccugauuacauggacgagaaaaacugcucauuuugccaagaugaugagcuggaaugugcaaaccaugcgugugugucacgugaccuguggugugauggugaagccgacugcucagacaguucagaugaaugggacuguggugagcuacuuguuucugccaucuguuguacucucucaugccugucagccacugaagcugaauggauccuaaauuacuuccuggauuuuacugaccaaguucaucuauuuuguuuuacuguuauaaaagcugauagugcugaucuauguguguuauuuccaacucacagaaaauuuccccacgaagcuacuucucuauuugaaauaucuauauuguauggaaaaacguuuggguucaaaauguuguaaucauauaauugcugggagaggauuuaaaaacucuucauuaaaacccaacuucaauaaugacccucucuauaaaugugaacuccucuuccuuucugaugguucacagagcugccacagaacaccaugugugugcagauggcuggcaggagauauugagucagcuggccugcaagcagauggguuuaggaacagggagaauaugacaagauucaagaagagauuuuugaaaucagauacaaaauguuuaguauaaauguuucaaguuuggaacaggauauuuagaauugcaaaaaauuuaucuuauccacugugaaaggcauuuauaugucaagaugaacugucaaggacugaggcuggaugcuuagauuauuuucccccaucaauagauggaagaggacaaaccuuauccuucaacugaaguguguuacaugucuagguaauuccugcacuucugucuuguuguuagagagaaccaucugugaccaaauugauacaggaacaggagaaagagccgcgguggcugacauuacacuccaacugggagagccucaaugggaccacuuuacaugaacuucuaguaaaugggcagucuugugagagcagaaguaaaauuucucuucuguguacuaaacaagacugugggcgccgcccugcugcccgaaugaacaaaaggauccuuggaggucggacgagucgcccuggaagguggccauggcaguguucucugcagagugaacccaguggacauaucuguggcuguguccucauugccaagaaguggguucugacaguugcccacugcuucgaggggagagagaaugcugcaguuuggaaaguggugcuuggcaucaacaaucuagaccauccaucaguguucaugcagacacgcuuugugaagaccaucauccugcauccccgcuacagucgagcagugguggacuaugacaucagcaucguugagcugagugaagacaucagugagacuggcuacguccggccugucugcuugcccaacccggagcaguggcuagagccugacacguacugcuauaucacaggcuggggccacaugggcaauaaaaugccauuuaagcugcaagagggagagguccgcauuauuucucuggaacauugucaguccuacuuugacaugaagaccaucaccacucggaugauaugugcuggcuaugagucuggcacaguugauucaugcaugggugacagcggugggccucuuguuugugagaagccuggaggacgguggacauuauuuggauuaacuucauggggcuccgucugcuuuuccaaaguccuggggccuggcguuuauaguaaugugucauauuucgucgaauggauuaaaagacagauuuacauccagaccuuucuccuaaacuaauuauaaggaugaucagagacuuuugccagcuacacuaaaagaaaauggccuucuugacugugaagagcugccugcagagagcuguacagaagcacuuuucauggacagaaaugcucaaucgugcacugcaaauuugcauguuuguuuuggacuaauuuuuuucaauuuauuuuuucaccuucauuuuucucuuauuucaaguucaaugaaagacuuuacaaaagcaaacaaagcagacuuuguccuuuugccaggccuaaccaugacugcagcacaaaauuaucgacucuggcgagauuuaaaaucaggugcuacaguaacagguuauggaauggucucuuuuauccuaucacaaaaaaagacauagauauuuaggcugauuaauuaucucuaccaguuuuuguuucucaagcucagugcauagugguaaauuucaguguuaacauuggagacuugcuuuucuuuuucuuuuuuuauaccccacaauucuuuuuuauuacacuucgaauuuuaggguacacgagcacaacgugcagguuaguuacauauguauacaugugccauguuggugugcugaacccaguaacucgucauuugauuuauuaaaagccaagauaauuuacauguuuaaaguauuuacuauuacccccuucuaauguuugcauaauucugagaacugauaaaagacagcaauaaaagaccagugucauccauuuagguagcaagacauauugaaugcaaaguucuuuagauaucaauauuaacacuugacauuauuggaccccccauucuggauguauaucaagaucauaauuuuauagaagagucucuauagaacuguccucauagcuggguuuguucaggauauaugaguuggcugauugagacugcaacaacuacaucuauauuuaugggcaauauuuuguuuuacuuauguggcaaagaacuggauauuaaacuuugcaaaagagaauuuagaugagagaugcaauuuuuuaaaaagaaaauuaauuugcaucccucguuuaauuaaauuuauuuuucaguuuucuugcguucauccauaccaacaaagucauaaagagcauauuuuagagcacaguaagacuuugcauggaguaaaacauuuuguaauuuuccucaaaagauguuuaauaucugguuucuucucauugguaauuaaaauuuuagaaaugauuuuuagcucuaggccacuuuacgcaacucaauuucugaagcaauuagugguaaaaaguauuuuuccccacuaaaaaacuuuaaaacacaaaucuucauauauacuuaauuuaauuagucaggcauccauuuugccuuuuaaacaacuaggauucccuacuaaccuccaccagcaaccuggacugccucagcauuccaaauagauacuaccugcaauuuuauacauguauuuuuguaucuuuucuguguguaaacauaguugaaauucaaaaaguuguagcaauuucuauacuauucaucuccuguccuucaguuuguauaaaccuaaggagagugugaaauccagcaacugaauuguggucacgauuguaugaaaguucaagaacauaugucaguuuuguuacaguuguagcuacauacucaauguaucaacuuuuagccugcucaacuuaggcucagugaaauauauauauuauacuuauuuuaaauaauucuuaauacaaauaaaaugguaauggucuaauca

SEQ ID NO: 1192 - RNA, 265 nt, Homo Sapiens
gggcuguaaauacuacuauaagaagaaaauacuacuacauuuuacagacugaaaguuuuucagggacaagaaccaaguguuauucaucuucuuccacgucuagcagaguccuugacaccuacugguccucaagaaaaguugaaugaaugaagaaacaaaugaacaaacaugcugaguuuagguugaugauugaugguagaacacacaggugauauccagcagaaaaggucaucaaauaaaguuuauacauacguuggaccauaaa

SEQ ID NO: 1193 - RNA, 2489 nt, Homo Sapiens
auucuccugccucagacuccggaguagcugggacuacaggcgccggccaccaagccuggcuaauuuuuuguauuuuuaguagagaugggguuucaccguguuagccaggauggucuggaucuccugaccucuugauccacccgccuuggccucccaaagugcugggauuaacggugugagccaccucgcccagccuggagcccuuucuuuaauauaaacauaaauguuagucaacuuguuuaaauauaaacaugugagcugcuugagcacagggacuacaucauaauguuuuuugcucucuuacaugucucaucaacgaauggauuaguguaaaaguuacauuuuaacuucuugacugauuuauacuggaugucaccaugagaaaugacagaaaggagcagcaacuggaaaacaagcauugcauugcaucaggaugucuaugaaauggacuucagcucuucugcugauacagcugagcuguuacuuuagcucugggaguuguggaaaggugcugguguggcccacagaauucagccacuggaugaauauaaagacaauccuggaugaacuuguccagagaggucaugaggugacuguauuggcaucuucagcuuccauuucuuucgaucccaacagcccaucuacucuuaaauuugaaguuuauccuguaucuuuaacuaaaacugaguuugaggauauuaucaagcagcugguuaagagaugggcagaacuuccaaaagacacauuuuggucauauuuuucacaaguacaagaaaucauguggacauuuaaugacauacuuagaaaguucuguaaggauauaguuucaaauaagaaacuuaugaagaaacuacaggagucaagauuugauguuguucuugcagaugcuguuuuccccuuuggugagcugcuggccgaguuacuuaaaauacccuuugucuacagccuccgcuucucuccuggcuacgcaauugaaaagcauaguggaggacuucuguucccuccuuccuaugugccuguuguuaugucagaacuaagugaccaaaugacuuucauagagaggguaaaaaauaugaucuaugugcuuuauuuugaauuuugguuccaaauauuugacaugaagaagugggaucaguucuacagugaaguucuaggaagacccacuacguuaucugagacaauggcaaaagcugacauauggcuuauucgaaacuacugggauuuucaauuuccucacccacucuuaccaaauguugaguucguuggaggacuccacugcaaaccugccaaaccccuaccgaaggaaauggaagaguuuguccagagcucuggagaaaaugguguugugguguuuucucuggggucgauggucaguaacacaucagaagaaagggccaauguaauugcaucagcccuugccaagaucccacaaaagguucuguggagauuugaugggaauaaaccagauacuuuaggacucaauacucggcuguacaaguggauaccccagaaugaucuucuuggucacccaaaaaccagagcuuuuauaacucaugguggagccaauggcaucuaugaggcaaucuaccauggaaucccuauggugggcguuccauuguuugcagaucaaccugauaacauugcacacaugaaggccaagggagcagcuguuaguuuggacuuccacacaaugucgaguacagacuuacucaaugcacugaagacaguaauuaaugauccuuuauauaaagagaaugcuaugaaauuaucaagaauucaucaugaucaaccagugaagccccuugaucgagcagucuucuggauugaauuugucaugcgccauaaaggagccaagcaccuucggguugcagcccacgaccucaccugguuccaguaccacucuuuggaugugacuggguuccugcuggccuguguggcaacugugauauucaucaucacaaaaugucuguuuugugucuggaaguuuguuagaacaggaaagaaggggaaaagagauuaauuacgucugaggcuggaagcugggaaacccaauaaaugaacuccuuuaguuuauuacaacaagaagacguugugauacaagagauuccuuucuucuugugacaaaacaucuuucaaaacuuaccuugucaagucaaaauuuguuuuaguaccuguuuaaccauuagaaauauuucaugucaaggaggaaaacauuagggaaaacaaaaaugauauaaagccauaugagguuauauugaaauguauugagcuuauauugaaauuuauuguuccaauucacagguuacaugaaaaaaaauuuacuaagcuuaacuacaugucacacauuguacauggaaacaagaacauuaagaaguccacugacaguaucaguacuguuuugcaaauacucagcauacuuuggauccauuucaugcaggauuguguuguuuuaacuguuguugaggaagcuaauaaauaauuaaauugua

SEQ ID NO: 1194 - RNA, 1680 nt, Homo Sapiens
gacuuggaaguaaaauauagagcuucuacugaaauauuuggggaccuuaaaggacuuucauuucucuccccuuccuucaucucuccuccuucacuuaccuucauuuauuauucuaggcaugacaagugucagaugucugauuugaagacuaauaugaauauaucuagagcauuuaaacuucagacuucaaccacaguugugauuguuuuuaguuuguuagcugccuggaguguuauuuuaagaaagcagaagcaccaucauuugcacacuccuuauagaucacacaccuuaacccugacuuuuuuugcuccaguuuuucagaagaagugaagucaagaugaagaaccauuugcuuuucuggggaguccuggcgguuuuuauuaaggcuguucaugugaaagaaaauggaauacauucugaauuuagagguucaagagauucuucugccucagccucccgaguagcugggauuacagcccaagaagaugaaaggauuguucuuguugacaacaaauguaagugugcccggauuacuuccaggaucauccguucuuccgaagauccuaaugaggacauuguggagagaaacauccgaauuauuguuccucugaacaacagggagaauaucucugaucccaccucaccauugagaaccagauuuguguaccauuugucugaccucuguaaaaaaugugauccuacagaaguggagcuggauaaucagauaguuacugcuacccagagcaauaucugugaugaagacagugcuacagagaccugcuacacuuaugacagaaacaagugcuacacagcuguggucccacucguauaugguggugagaccaaaaugguggaaacagccuuaaccccagaugccugcuauccugacuaauuuaagucauugcugacugcauagcucuuuuucuugagaggcucuccauuuugauucagaaaguuagcauauuuauuaccaaugaauuugaaaccagggcuuuuuuuuuuuuuugggugauguaaaaccaacucccugccaccaaaauaauuaaaauagucacauuguuaucuuuauuagguaaucacuucuuaauuauauguucauacucuaaguaucaaaaucuuccaauuaucaugcucaccugaaagagguaugcucucuuaggaauacaguuucuagcauuaaacaaauaaacaaggggagaaaauaaaacucaaggacugaaaaucaggagguguaauaaaauguuccucgcauucccccccgcuuuuuuuuuuuuuuuugacuuugccuuggagagccagagcuuccgcauuuucuuuacuauucuuuuuaaaaaaaguuucacuguguagagaacauauaugcauaaacauaggucaauuauaugucuccauuagaaaaauaauaauuggaaaacauguucuagaacuaguuacaaaaauaauuuaaggugaaaucucuaauauuuauaaaaguagcaaaauaaaugcauaauuaaaauauauuuggacauaacagacuuggaagcagaugauacagacuucuuuuuuucauaaucagguuaguguaagaaauugccauuugaaacaauccauuuuguaacugaaccuuaugaaauauauguauuucaugguacguauucucuagcacagucugagcaauuaaauagauucauaagcaua

SEQ ID NO: 1195 - RNA, 469 nt, Homo Sapiens
aucaagccuaccuccgguuguuuugucacgugguguuccaggucugcuggauuuugcuggggguccacuccagaagcuguuuuccuggguaucaccagcagaggcugcagaacagcaaagauggcugccuguuccuuccucuggaagcuucaucccagaggagcacccgccagaugccaguggaaucucuccugcgugaggugucugucaacccuuggaagcaccggggucagggacccauuugaggaggaaucuagagaggcagucugucuacagcgguuuugucaaaacuccuuauuguuuaacuaagaaaaaaaaaucccccaaacaguuucugacuuuuguuuccuugguucaucuuccucucauuguaucacagggcuacuugauuguauuucaguauucaauuuauauauuucauauucugcugaaugcauagaauauaaauuaaaaauucuuuuucucaagc

SEQ ID NO: 1196 - RNA, 16934 nt, Homo Sapiens
gcggccgcagaaucgagcucgggccccggcccccggcccgcggcgcggggcucccgggccccgccgcggacgucgcgccggucgccccuuccccguagcccgugcgcccucggcgcggagccccggcccgccgcggucccgucuccugggccugucccgcccgcgcccuccgccggcccucagguauaauacuucuccacgucugcuucaggaagaaagugccugccauucuuaucauuucuaagcagguucaugccagcccagaacagagaaucagcuggagcccagauuucaaguuuugaguaaaauaccuucaagcgaaugggcccuauugugcucacacauucagaaccuguuacccaaggaauucccuaaagaugucuucaauugcuguggugacaagaacauagugaauauaagcugcugaaaguagagcuagucguggcuggaacagagagaaauucagaauuagaagugcgucucaccaaccagccaagaugaacauggugaagaggaucauggggcggccgaggcaggaggagugcagcccacaagacaacgccuuaggacugaugcaccuccgccggcucuucacggaguugugccauccuccccggcacaugacucagaaggaacaagaagagaaacuguauaugaugcugccaguguuuaacaggguuuuuggaaaugcuccgccgaauacaaugacagaaaaauuuucugaucuucugcaguucacaacacaagucucacgacuaauggugacagaaauucgaaggagagcaucaaacaaauccacagguauuuuuacaguagccagcaaaaacugauuuguuugaaugaacaagcaguucuguaaaagucccauuaaaauuaaauggaaaacagaccuuguucucagcacauugaguucauuuacccauucccuuucccuuucuuagagucacauucuuuuccugguuucagcaucuucaacucuccaguaguucugcucaaggcuacucugccuggaccacuaccacuuccacccaaaaacagugugcccugcugucccccaaggauuucaaagccacaacaccuucagaggcugcaagucgggccauaguucaguuccuagagauuaaucagagugaagaagccaguagaggcuggaugcuucuaacgacaauuaauuuguuagcuuccucuggucagaaaaccguggacugcaugacaacaaugucagugccuuccacccugguuaaauguuuauaucuguuuuuugaccuuccacaugugccugaggcaguuggaggugcacagaaugagcuaccucuagcagaacgucgaggacuacuccagaaaguuuuuguacagaucuuagugaaacugugcaguuuuguuuccccugcggaggagcuggcucagaaagaugaucuccagcuucuauucagugcaauaaccucuuggugcccucccuauaaccugccuuggagaaagagugcuggagaaguccucaugaccauaucucgucauggucuuagugucaauguagugaaguauauucaugagaaagaguguuuaucuacauguguucagaauaugcagcaaucagaugaccugucuccccuagaaauugucgaaauguuugcugggcuuucuuguuuccucaaagauuccagcgauguuucccaaacacuucuggaugauuuucggauauggcaaggauauaauuuucuuugugaucucuugcuuagauuggaacaagcaaaagaggcagaauccaaagaugccuugaaagaucugguuaaucugauaacuucccuaacaacauauggugucagugaacuaaaaccagcugguauuaccacaggggcacccuuuuuauugccuggauuugcaguaccucagccugcaggcaaaggucacagugugagaaacguccaggccuuugcaguucuucagaaugcauuuuuaaaagcaaaaaccagcuuccuugcccaaaucauccuugaugcuaucacaaauauuuacauggcugacaaugccaauuacuucauccuagagucacagcacacauugucacaguuugcagagaagauuucuaaacucccagaaguacaaaacaaauacuuugagaugcuggaguuuguuguuuuuagcuuaaauuauauaccuuguaaagaacuuauuagugucaguauccucuuaaaaucuagcucuucuuaucacuguagcauuauugcaaugaaaacacuucuuaaguuuacaagacaugacuacauauuuaaagacguguucagggagguuggccuuuuggaggucaugguaaaccuuuugcauaaauaugcugcccuguugaaggauccaacucaggcacuaaaugaacaaggggacucaagaaauaauaguucaguugaagaccaaaaacaccuggcuuuauugguuauggagaccuugacagugcuucuucaaggaucaaacacaaaugcaggaauuuuucgagaauuuggaggugcaagaugugcacauaauauaguaaaguacccucaaugccggcagcaugccuugaugacuauccaacagcuggugcucuccccaaauggggacgaugacaugggcacucuccuggggcuaaugcauucagccccaccgacggaauugcaguugaagacugauauuuuaagggcccuccugucgguccuucgagaaagccaucguucaagaacaguuuuuaggaaaguuggaggauuuguguacauuacauccuugcucguugcuauggaaagaucuuugagcuguccacccaagaauggcugggagaaagugaaccagaaucaaguguuugaacuucuucacacuguguucugcacguugacugcagcaaugcgcuaugagccagccaacucucauuucuucaaaacagagauucaguaugagaaguuggcagaugcuguucgauuucuuggcugcuucucagaccuaagaaaaauaagcgccaugaaugucuuccccucaaauacacagccauuucaaagacuuuuagaggaagauguaaucucaauagaaucagugucacccacguuacggcacugcaguaaacuuuuuauuuaucuuuacaaaguagccacagauucuuuugacagguauggcucugcucuguccucugaauuaaaggguguauacuaagcaugacuucaacauuaagacuugaauuaugaguuaauccaaaagaauaugaaaacagaugacucuucuccuauuuguuugaaguguaucacuuuauuuuugaauauuacucuugcucugguauuguuuuuuuuuuuuuuuagcauggaagccuguguacuauuuguaaauucagguucaauuaguucucauugcaguuauuggaacaguuucuaugaaguuuccuuuaaugauaguguuuacuguuguuuuuuuucuuuuuagccucaaaaggugcaucuggacuuauugauauguguuaucaauagaacaucauuaugauuauucuuauuuccagacacguacuccaucauucuccacauaucauacuccucaaaaaaugauauaguucccaaagagaggugucagugucuugaaccgucaaguucaagaggccaucagacucaauauuuacucauuccuucaugaaauaaguacuuaacaaaaagcugcugcaugccaagucacugugcuaggcauugaggauucagcucuacacagggcugucuugguccuugcuaucuuuuagcuaaaauguagacacauaaauaaacaauuacauauagugugacacauucuacagugggggaauccaggguucucaggcagauuguaggagagccacuucaucuagaucacuuauuuucagugcuucaacuguguuuucaaugaagaugucacuuugaaaauaauacuucuaauuuaugccccaaguguuauugcuuuuaacuuaccauaguuuuacuacauaaaauaaaugaacugcccucaucaauagaccauguaacuacauuggauagagcuuguaauagguuuuguguccuuuucuguggaauaucugcuuugaaguaucaacugagauauuuccugcuucuuaacaagauuucuuaguccucaguauuuacauuuaaaaauccaaacagcuuugacaacaauuguucgugcagaacagaucccuccuugccugacaagugagucuucucuccccucuccuugggguacaccagcuuuguccaggaaaagauugaugagaagaaauguguacauucaggacauggcugggcuuucuaauucauagaaacuuuuucuguaaauugcuuucaaguuuuuaaaaguugcaaugaauauuuucagugauaaugaggauagaugcagaagaugaaaguaguuccaaauaagcuaaaggaaaacucccacaaugccaaauauauuuauucuuggauagcuuagacucugagacaacccugacucagcugacccaguuaguuguugauuguguuacucaugcacuaaggaaagguuaaaacacauauaggcaugcauaucauucuguuucaacucccccuguuuacccuccuaaaaauguugccgaccugaaacuacaugugacaacuucaucucugcagaguucugaugcagucaucauucauccuggagccaugcuugccaugcuggaccuacuggccucuguugggucagugacacagccagaacaugcuuuggaucuucaacuugccguggcaaauauuuuacaaucccuggugcacacagaaaggaaccagcaagucaugugugaagcuggucuucaugcacgacugcugcagaggugcagugcugcauuggcugaugaggaccacucacugcacccgccccugcagcggauguuugaacgauuagccucucaggcucuggaacccaugguguugagggaguuuuuacguuuggcaaguccuuuaaauuguggugccugggacaaaaaacugcuaaaacaauauaggguccacaaaccaaguucacugaguuaugaaccagaaaugagaaguaguaugaucacaucucuggaaggucuggguacugauaauguuuuuagcuuacaugaagauaaccauuaccggauaagcaagagccugguaaaaucugcggaaggaaguacuguaccccugaccagggugaagugucuggucuccaugacaaccccacaugacaucagacuucaugggucaucaguuacuccagcuuuuguugaauuugacacaucacuugaaggguuuggaugucuuuuuuugcccaguuuggccccucauaaugcuccuacaaauaauaccgucacaacaggucuuauugauggggcuguggucaguggcauugguucuggugaaagauucuucccuccucccuccggcuuaaguuacucuagcugguuuuguauugaacauuuuaguucuccuccaaauaaccacccugucagacuucuuacuguugugcgccgagcaaauucuucugagcaacauuacgugugccuugcaauaguucuaucagcaaaagaccgaucucugauuguuuccaccaaagaggaacuccuccaaaauuauguugaugauuuuagugaagaguccucauuuuaugaaauucucccaugcugugcucgcuuucgauguggagagcuuaucauugagggacaguggcaucauuugguccugguaaugagcaaaggcauguugaaaaacaguacugcagcccuuuauauugauggacagcuuguuaacacuguaaagcuucauuauguccacaguacuccaggggguucagguucggcaaauccaccaguggugagcacggucuaugccuacauugguacuccaccugcccaacgccaaauugccucauugguuuggcgccugggacccacacauuuucuagaagaaguuuuaccuucuucaaauguuacuaccauuuaugaacuuggaccaaauuauguuggaagcuuucaggcuguauguaugccauguaaagaugcaaaauccgaagggguggugccauccccugugucauuaguaccagaggagaaagugucauuuggccucuaugcacucucugugucgucucuaacaguggcaagaauccggaaaguguauaacaaauuggauagcaaagccauugcuaagcaguuaggcauuuccucacaugagaaugccacuccugugaaguugauacacaauucagcaggacaucuuaauggaucugcacggacaauuggggccgcucugauuggauacuugggaguaagaacauuugucccuaagccuguugccacuacuuugcaguacguugguggagcugcagccauccugggccugguggccauggccucugauguggaaggguuauaugcagcagucaaggcccugguuuguguggucaagaguaacccacuagccagcaaagaaauggaaagaaucaagggcuaccaguugcuggcaauguugcuuaagaagaaacguucccuucuuaacagccacauccuccaucuaacuuuuucuuuggugggaacuguugauaguggacaugagaccuccauuauuccaaauucaacugcuuuccaggaccuccucugugauuuugaagucuggcuccaugcaccauaugaacuucaucuuuccuuauuugaacacuuuauugaacugcucacagaguccagugaagccucaaagaaugccaaauuaaugagagaauuccaguuaaucccaaagcugcuccugacucuucgagauaugucuuuaucccagccuacuauugcugcuauuaguaauguccugagcuucuuacugcaagguuuuccuagcagcaaugaucugcucagauuugggcaguuuauuucuucuacuuugccaaccuuugcgguuugugagaaauuuguaguaauggaaauaaauaaugaagagaagcuugacacuggaacugaagaggaguuuggaggucuuguaucagcuaaucuuauacuuuugaggaacagacuucuggauaucuugcuaaaacuaauuuauacaucuaaagaaaagacaagcauuaauuugcaagcuugugaagaacuggugaagacacuggguuuugacuggaucaugauguuuauggaggaacacuuacauuccaccacaguuacagcagccaugaggauucuuguuguccuacuaaguaaucagucuauucucaucaaguuuaaagaaggacucagugguggaggauggcuugaacagacagauucugucuuaacuaauaagauuggaacuguauuaggauucaacgugggcagaagugcuggugggagaucgacggucagggagauuaaccgagaugcuugucauuuuccugguuuuccaguccuucagucauuccuuccuaaacacacuaaugucccugcccucuauuuucuccucauggccuuguuucugcagcagccaguuagugagcugccugagaaccugcaggucagugugccugucaucagcugccggaguaagcaggguugccaguuugauuuggauuccauuuggacauucaucuuuggaguuccugccuccagcggaacuguggucucuucuauccauaacguaugcacagaagcuguuuuuuuauuauugggaaugcuccgcagcaugcugacuucaccuuggcaaucagaagaagagggaucuuggcuccgagaauauccugugacccugaugcaguucuucagauauuuguaucacaacgugccagaccuugccuccauguggaugagcccugacuuccugugugcauuagcagccaccgucuuccccuucaauauucgcccuuacucagagauggugacugaccuugaugaugaaguuggaucuccagcagaagaguuuaaagcguuugcagcagacacagggaugaacaggagccaaucagaguacugcaaugugggcaccaagacauaucugaccaaucacccggcuaaaaaguucguuuuugacuucaugcgggucuuaaucauagacaaccucugucucacuccugccagcaagcaaacuccacuaauugaucuuuuguuggagguaaagaaaaagaaacgcauuuacaucucuuuugcauuacuuuuuaaauuagaacauuaguaaccaaacaaguucuauaacaaggauuucuaauuccucuuguuuauguguaggcagaacauguuauaggcuguggaaaguucuuaaucccacaugugcuuuaaacccuaucaguuuguucuuuuccuucccucaaggaugucucuaauucaguccuuuaucauccuuucucuaagcuuccccugaaaggucuacaagaacucagcaaaaagaauuucaaacuuacauuuuggauagcgugauggaccauuugcuugcagcugauguguuauuaggggaagaugcaucucugccuauuaccaguggaggaagcuaccagguauuggugaacaauguguuuuauuucacacagcgugugguggacaagcuuuggcaaggcauguucaacaaagaaucuaaacuucuuauagauuuuauaauucaacuaauugcacagucaaagagaagaucacagggauugucacuggaugcaguguaucauugccucaauaggaccaucuuguaccaguucucacgggcacacaaaaccguuccucagcaaguagcucugcuugauucacucaggguccucacuguaaacagaaacuugauccugggaccugggaaccaugaccaagaauucauuagcugucuggcccacugcuugauaaaucuacauguuggaagcuauagaucagucuaauuacauuuagucagguggauuuauuugaucaccucuuaaaaauggcaucuuccuggcaaacuagaauucuguucugugcaucugcugaguagacauucagugucugcugguaauggaaauagaguaauucuuaguuacuguagucuucagcuaaucauuuccuucauaaaguuuaaacugacuggaauuuuucagcaacguggauggauuuggacuggaagcagaagcccgcaugaccacauggcacauuaugauccccucggacauugaaccagaugguaguuacagccaagauauuagugaagggcgucagcuucucauaaaagcugucaacagaguuuggacugaacugauacauaguaagaaacaagucuuagaggaacuuuucaaaguaacucuaccugugaaugaaaggggccacguggacauagcuacagcaaggccacucauugaagaagcugcccugaagugcuggcagaaucauuuggcccaugaaaagaaaugcauaagucgaggagaagcuuuagcgcccaccacacaguccaaauuaucccgugucagcaguggcuuuggucuuuccaaguuaacaggaucaagaaggaaucgaaaagaaaguggucuuaauaaacacagucuuuccacccaggagauuucgcaguggauguuuacucacauugcuguuguucgugacuuaguagauacacaauauaaagaauaucaggagcgucagcagaaugcccugaaguacgugacagaagaguggugucagaucgagugcgagcuguugagggagcgggggcuguggggcccucccaucggcucccaccucgacaaguggaugcuggagaugacagaagggcccugcaggaugaggaaaaagauggugcgaaaugauauguuuuauaaccauuacccuuacgugccagaaacugagcaagagacaaauguggcgucugagaucccaaguaaacagccugagacacccgaugauauuccucaaaagaaaccugcucgauauagaagagccguaaguuaugacaguaaagaguacuacaugcgacuggccucuggcaaucccgccauuguccaagacgccauuguggagaguucagaaggugaagcugcucagcaagaaccagagcauggggaagacacuauugcuaaagucaaagguuuggucaagccuccucuaaaacgcucccgaucugcaccugauggaggagaugaggagaaccaggagcagcuacaagaccagauugcugagggcagcuccauagaagaggaggagaaaacagauaaugcuaccuuacugcgccuguuagaggaaggagaaaagauccaacacauguaccgcugugcucgaguccagggccuagauaccagugaggggcuccuucuuuuugguaaagagcauuuuuaugugauugauggauuuaccaugacagcaaccagggaaauaagagauauugaaaccuuaccuccaaauaugcaugagccuauuauuccuagaggagccaggcaaggcccuagucaacucaagagaacaugcagcauuuuugcauaugaagauaucaaggaaguucauaaaaggagauaucuccugcagccuauugcuguggaaguuuucucuggagauggacggaauuaccuccuugcuuuucagaaaggaaucagaaacaaagucuaucaaagguuuuuggcuguagugccaucucuaacggacaguucagaaucuguaucugggcaacgaccaaacacgaguguggagcagggaucuggguuacuuagcacuuugguuggagagaagucugugacucagagaugggagagaggugaaaucagcaacuuccaauauuugaugcauuugaacacuuuggcuggcagaucauauaaugaucucaugcaguauccugucuuccccuggauccuugcagauuaugacucagaggagguggaucuuacuaaucccaagacguuuagaaaccuggcuaagccaaugggagcacaaacagaugaacgauuagcucaguauaagaagcgguauaaagacugggaggauccuaauggagaaacuccugcauaccacuaugggacccacuauucaucugcaaugauuguggccucauaccuuguaaggauggagccuuucacacagauauucuuaaggcuacaggguggccacuuugaccuggcugaccggauguuucacagugugcgcgaggccugguauucagcgucaaagcacaauauggcagauguaaaagaacuuaucccagaguucuuuuauuuaccagaauuccuguucaauuccaacaacuuugaucuaggcuguaaacaaaauggcaccaagcuuggagauguuauccuuccacccugggcaaaaggggacccacgagaauucaucagaguccaucgugaggcuuuggagugugauuacgugagugcccaucuacaugaguggauugacuuaaucuucgguuauaaacagcaaggcccugcugcaguagaagcuguaaaugucuuccaucaucuuuuuuaugagggucaaguggauaucuacaacaucaaugacccacuaaaggagacagccacaauuggguucauuaauaacuucggucagaucccuaaacaguuauuuaaaaaaccucauccaccaaagcgagugagaagucgacucaauggagacaaugcaggaaucucuguccuaccaggaucuacaagugacaagaucuuuuuucaucaucuagacaacuugaggccuucucuaacaccuguaaaagaacucaaagaaccuguaggacaaaucguauguacagauaaagguauucuugcgguggaacagaauaagguucuuaucccaccaaccuggaauaaaacuuuugcuuggggcuaugcagaccucaguugcagacugggaaccuaugagucagacaaggccaugacuguuuaugaaugcuugucugaguggggccagauucucugugcaaucugccccaaccccaagcuggucaucacggguggaacaagcacgguugugugugugugggagaugggcaccuccaaagaaaaggccaagaccgucacccucaaacaggccuuacugggccacacugauaccgucaccugcgccacagcaucauuagccuaucacauaauugucagugggucccgugaucgaaccuguaucauuugggauuugaacaaacugucauuucuaacccagcuucgagggcaucgagcuccaguuucugcucuuuguaucaaugaauuaacaggggacauuguguccugcgcuggcacauauauccauguguggagcaucaaugggaacccuaucgugagugucaacacguucacagguaggagccagcagaucaucugcugcugcaugucggagaugaacgaaugggacacgcagaacgucauagugacaggacacucagauggagugguucggguguaguggugcaaucucggcuuacugaaaccucugccucccagguucaagcaauucuccugcaucagccucccaaguagcuggaauuacaagcaugcacugcuaugcccggcuaauuuuuguacuucuaguagagacaggguuucaccauguugaccuggcuggucucaaacuccugaccucaaaugauccgcccaucuuggcuucccaaagugcugggauuauaggcagcacuacaccuggccugaaccauguuuuuaaacuaauaugacuauaaucuuuuucccuguacuuugaaacagccauugugugcaggcagcccgcugccacaucuuccaagauacgggaaaucuaacuguauaacaugauggaaauuaaguuaucuguuaacccugacagucucucuucauugaguaauguaaauugguuccuuaaucuguuucuuaacuuuuuaauuuuuguacuuauuuaaauuuaguuuuggagaauggaauuuuugcaaguuccugaaacaccagcuccugagccugcugaaguccuagaaaugcaggaagacuguccagaagcacaaauagggcaggaagcccaagacgaggacagcagugauucagaagcagaugagcagagcaucagccaggacccuaaggacacuccaagccaacccagcagcaccagccacaggccccgggcagccuccugccgcgcaacagccgccugguguacugacaguggcucugacgacuccagacgcugguccgaccagcucagucuagaugagaaagacggcuucauauuugugaacuauucagagggccagaccagagcccaucugcagggcccccuuagccacccccaccccaaucccauugaggugcggaauuacagcagauugaaaccuggguaccgaugggaacggcagcugguguucaggaguaagcugacuaugcacacagccuuugaucgaaaggacaaugcacacccagcugaggucacugccuugggcaucuccaaggaucacaguaggauccucguuggugacagucgaggccgaguuuucagcuggucugugagugaccagccaggccguucugcugcugaucacugggugaaggaugaagguggugacagcugcucaggcugcucggugagguuuucacucacagaaagacgacaccauugcaggaacuguggucagcucuucugccagaagugcagucgcuuucaaucugaaaucaaacgcuugaaaaucucauccccggugcguguuugucagaacuguuauuauaacuuacagcaugagagagguucagaagaugggccucgaaauuguugaagauucaacaagcugaguggagaccauggucuguagaccccuucccgauucuccugucccagcuuggaaggcauugaaaacagucuccguuuacacaucucuucauaccacguguuugaaguguuaaaauucaaagggaucauugaauaaaacggguguagaguacaggaauggggcagacgcgauucaggugaacagcacaagaagaauaugaggugguuccuaggagcaacacuuucgaccuccaguucucccugaugacaguagcugucuccaagagaaaaauccucacuuauuaacucucuuuucuugcaucucauuuuuauagagcuacucauccuuauuuggaaaaaccaacaacaaaaaaggcuuuuagaaaaugguuguaaaucugacuucuuugcaaguaacuauguauauuguaaauagauauaaaaggccuuuuuucuaaauaaggacuuaacugccuguaacaugaaacuucaaacuaaaccacuaacucaaugaacuacuuaugguuugucugacaucccucacuuaccaauuaauuauaaauauguuuuuuuaaauccccaaagacauuaucuguggucuuuuuuuccuuucaagcucagccugugugccugaugucauuucuuucaaguugcccacaguaucuccacuuaaacuaggcuaguaaccaaaauaauguggaccuucuuuaggaaacagugugggagaauaggaguccagccguaagauaaacuggaaauauuugggcgucuuguaccuggcuacgcaccaccucaguguuguuccuacauaaacagggccccuuuuaaacuuguauguggacugcuguuuggucaaagaauaccuucuuagcauugcagaaagguggucagaugaccaguguagugcaggaaacagcccugucucaacuaauggaaauauauuugcauguaacccaaaauuagcuuaucuugcauagaacauaauaaguaugugucuuuggugacacuaauguucuacuauagcuuauuuucaaacaagggguaaaaaaaggaaagaaagaaguguacagaauuaacauauaaacuuuguuguaaaacugaaucaugucagaacugcuuaaaauuaaccuuuaccauuuaaugucaucuaccugaaaacagugagauuuauacuguaucaaugucuauuuuuuuguuuuugcuaugaauauaauuacaguauuuuaauauuuaguuauuuaauuuguucuacuaguuggauacagaacacacaaauccagggggauuaaagcuggaaggggcuaagagauuaguuuacagagaaaaggcuugguggugggauuuuuuuaaauguguguuauguacauauauauauauauauaauauauauuaaaaaugaaacaauuaaucuagauuuuaacauuuucagaaacuuagugauaacauuaugaacaauucuaaaagcccugugauuugaaaaauauagaaucauuaauggcccaagauaggccuucacaccuucacaggugcgaaaggaaaggccuucacacccucacagaggcaucaugcaaaggacagcggcuuuggcuuuuccaauuuuccaucuuuaggcccuggugagaggcacacuuaugcacuaaaaugcacauauaugcacaugcauucaaaaauaggcauuugguacaauggugaucuuguaccugaugggcugaaaccagcuuaagaacaaauuuguucuuccugauaugauaacuaggucuccaagagaaaauagaaaggcugcuuuagugccuuacgcuuacuaaauuuaaaucuuuauuuaccuggguuugagccuacagucuauuuaugauuacauaucaaaauugauuaaaacacuuccauuucuaaaaguucaaauauacuuguuaauaaaaggauuaucggcauuaauacuuuaauuuaaagaaaaguuguguucuguuuuccuuucugugucuuacuccccccacacucucccucccccaucaccaucuucaauucuaauaaauaaugcugauguucaacaguugcagaaauugugcuauuauguaacugugggccuugccccugucuggcccucuagaugauuuguagcaguguuauucuacacuuuuuaaaagaagcguccuccuuuuguccaugaaucauguuuaccccauacccaguggcagagguguucuuuaaagacuugaauauaugaauguguguguguaguuacuuaaagguuauuccucuuuguaauaggaaacuauaugggaugaacacuuuuaaacuuuccgacacaacuuccauuacuaacuuucuaacagaacuuccauaacuagaagguggaaaccaaaacccucaugguaguauuuccucuggcagcuggugcugugggcaacuguuuuguucaaucggguuucuuuucuuuuugccucuaaugcagaaaucaacagaaucacucacacauacaaguacacucacauacauaaacuaauuauuucucuggauaucuuucuguguuccauguaaauuuauuuaccaacaucuauugucaacauguacaucuaccuuaguauggucugcauucuuuuucugagaguaccucauagggcuccugccugaucuuuguaguuuguucauucauccauccaccuguucauuuguucauccauguauucuaacauuucuauguagugugcaacucuaaugucaugcuuuugaagaagagaauagcugcccauagcagccauccgucuggauaauagcaaaacacucuagauaaguuauuuugcacuuucuuauguauaaaguugguagaaacuuauuuuugcuuuguaucauuuaaauacauuuuguuuugguaaaugaacuguguauaaaauauuuaugccguuaaaacuguuuuuagaaaguauuuuuaauuucagcaaguuugguuacuuguugcaugacucuuaacacagcugacuuuuugugucagugcaauguauauuuuuuguccuguuauuaacuuguaagcccuaguaauggccaauuauuuguacagcaacagaaguaaauugaagauacuggcuaagacuggauugauuguggacuuuuauacuauauugcagaaaccaauaucuguuucuuggugguuauguaaaagaccugaagaauuacuaucuagugugcagucugugauaucugaauguucauuguauauuugucucugaugcaaaaagguagaguaacacaauuacaauacaugauuaaaugcaauaguccagguacuuaaguaauuuuuuuuucauuucaaauaaauaccuauuuaccaccaaaagaaagaaaaagaaaa

SEQ ID NO: 1197 - RNA, 257 nt, Homo Sapiens
agaucaucugaaaggaaggagaauggugaaggcagagagaagcaugaggaaucaggacauuggacaaagccuucacaugauuuuagaggauuaaacugcuucggcaucuaguaaacuccucccagaaggaaaacuagagacaugcuuuucccuaaauacuacuucagagcccauaauaaaggugcauauugaacaaguggaucuucaucaagaaugaaagcugucugcuucaaaguaaaaucugucacagugucauc

SEQ ID NO: 1198 - RNA, 2321 nt, Homo Sapiens
ucuaagaggugaucaaacgccagcuauggagagagaugcagaggaaagcgaagacauaugcacuggcauuuguagaagggccuggaugggggugaggagcacacggaaaauggucugaggccaucuaugcaguuccugaagaagcaccucgggcagcuacugacacucccagcccagcucuacagggguggguacaugggugggcugggaacagggugucuguccaacaggcggguguugagggcccagaagaugucaggguagcaacaggaggaaucuggugcaguaugagcacacggccgucagcugauagugggaagccagucaagugccgcgaaagcaggaggcggggccgcggccaacgucauucccgcggccgcacgucaccgccacuugccgcauccgcaagaucucucuggaccagcucgggugcagggccucugcgggagcccuccuagaccucugcggcuucuccucuaacauggccgacucggaaaaccaggggccugcggagccuagccaggcggcggcagcggcggaggcagcggcagaggagguaauggcggaaggcggugcgcaggguggagacugugacagcgcggcuggugacccugacagcgcggcuggucagauggcugaggagccccagaccccugcagagaaugccccaaagccgaaaaaugacuuuaucgagagccugccuaauucggugaaaugccgaguccuggcccucaaaaagcugcagaagcgaugcgauaagauagaagccaaauuugauaaggaauuucaggcucuggaaaaaaaguauaaugacaucuauaagccccuacucgccaagauccaagagcucaccggcgagauggaggggugugcauggaccuuggagggggaggaggaggaggaagaggaguacgaggaugacgaggaggagggggaagacgaggaggaggaggaggcugcggcagaggcugccgcgggggccaaacaugacgaugcccacgccgagaugccugaugacgccaagaaguaaggggggcagagauggaugaagagaaagcccacgaagaaaaaagccugguuuuguuuuucccagaauaucgauggacuuaaaaaggcucagguuuuugaccaaaauacaaugugaauuuauucugacauuccuaaaauagauuaaauuaaagcaauuagauccuggccagcucgauucaaauuugacuuucauuuugaacauaauaaauauaucaaaagguguuaaagaaaacugaauuaaacccaaaauuauguuuucauggucucuucucugaggauugagguuuacaaaggguguuagcagaugcgaaguaaagaacgucacuuugaaacccauucaucacacagcauacgcuacacauggaacacccaagccaugacugaacacguucucagugcuuaauucuuaaauuucuuuacucaugacauuucgcagugcagagaaggcagaacccaagaaaaacgucaucuuugagacuuugcuuuuguaacgcagacaucagcuuuacacuucacaggagauugauggcauugaggaagauugcaauggagaucaugacacuacuguuaauaaggccaggaaaacugccauuucaaguucugaaaaauguuuugaguauuugaauuuagagaaacaacaugguuccaagaaggaggguguaaaaccuguaaaauacugucaacauauguauucauuaguuacaaucucauguuuguguuuucuuaguacugucuauuuacaaacacguaaaaaauaccccaaauauguuuaaguauuaaaucacuuuaccuagcguuuuagaaauauuaauuuacuugaagagauguagaauguagcaaauuauguaaagcauguguauccagcguuauguacuuugcgccuugugacgucuuucugucauguagcuuuuaggguguagcugugaaaaucaucagaacucuucacugaagcuaauguuuggaaaaaauauauacuugaagaaccaauccaagugugugccccuacccccagcucagaaguagaaaggguuuaaguuugcuuguauuagcugugccuucauuauuuugcuauguaaaugugacauauuaauuauaaaauggugcauaaucaaauuuuacugcuugaggacagaugcauacaguaaggauuuuuaggaagaauauauuuaauguaaagacucuuagcuucuguguggguuuugaauuaugugugagccagugaucuauaaagaaacauaagcuuaaaguuguuuaucacugugguguuaauaaaacaguauuuucaaaaaaua

SEQ ID NO: 1199 - RNA, 5838 nt, Homo Sapiens
cggcuuccuuuuucuccacacuucuagcuaccuuguuuuuaucguuuucggcaccugcccuuccccagcgcccccaccaccccgagcacuauguaugaucgggcuccccgccugcucaaauuggcugaagguggcagcacugaggcccauguggguccuggauccuaccagguaccuuuccugaagcagcaggcgacagguaguaaugcaccauuucuuucuuugacugccagagaaaguacuuuuaccauugccucuagcauugagaaagcuguuccagguccaggacacuauaauguuucagaagcacagaaaauuucaagaucaccuacacuuaccagaaguguugauguuccuucaauuccuucuuguggaaagucauaugguuaucauauuaaugaugauggcaguauuauaaaauguuuuccaccugcuugugacaguacacuugguccagcauacuacaaaccucaauuugauguuuccaaugcaacuuugaaauacaaagguauacauuuuggcaacucuucaggaagacaagaguuaccuaaaaagucagguccugguccaggacaguaugauauaguccagaaaaagacaucauauuaugaaaauguuaacaucaagagagaucaacaacaaaauuauuguucauuuaucccacgacuauaugaaauaauaguauugcaggagaaaaaaaagagauuuuuaccuaugaaaucaaucaccccggcuccuggcacauauaaugaaccucgaacugcucucaagucuuugaagaaaacaucaggacugaaaaauauuccauuuggucaaagugcuguucgauucacacaggacaucaggacagaggaaaugccagguccuggauuuuauaaugucuugaacaauacuauaauugccaguguuagaaauaucugcucaaagaaacagaagaaaagugcauuugguucuucuguuccucggacuuucuucucgguucagaaagaagcuugugcuaccccuggaccugcugauuaucaggaauuuuggcauucacagggugugggaauuucugaugaauuaccuaacuugacuaacaaauaugcugcuuucuugucaagagccaaaagaacuaugaaaguaccagauaugcucuuucaccaacacccuccguauagcacuuaggauauaggccaugcaguaccccugcuaugaggaaccuaaugaggaauguaguuaguuucccucccuaacuggaagaagcuaagcaggugguaucugaauguuauggucaaaggagaaggguuauuccagcgccaggcagcuaugauguucacaaaucauaugagaugucccaaguuaagcauaaauauaugccaccucguaguuuaguggcuaaaagaaaacaugccucuuuucuuagugcaacuccucggugccuagaaaaagugacugaugggccagguccugcagcauacaauccuguuuuaaggaaaucuugccccauacccuuauuugugaaagcaucaaagcgcuuugaagaguccaaagagauuacuccaggcccagcaacauaugagauaucccaggagaaaaagaaaggaaaucucauuggugaaauggcugcugauauaaugugacauaaauuuauggcaaaaacuuaaaaaacaacuucauggaagucaguuuauuucuuugucauuuuaacaaaauuuauuccaaauauaggaguaauaaaagcauaauuuucacuuguucaggcauucgcucaggcuuuagugacuauaugacacaaccacggagaaauaaaccuuguuaagacaaucaaaaguaauuuaaaaaaaaacaacauuaauagaaguucaucauaaucacaugagaaaauauggaaaaguaaaugaaagaaaauaaaaagaucuguaacagcaacaccuggaaaugccacuguuaacacugagguugagguccaguuacugcaacaucaguauugaaaagaugauuuugcuucauugcacugccuuugcuucuucgucaaaggaaugaccauuguugcauuacuacugggauuugaaaacacagcgugaucccugugggugguacaauuuccucugaggaaugaauaauacagaggaaagcccacguggacugaggacauacuacauggagcauggaggugauaagaccauuucuucaggaaugaccagaauagcauaaaagaucaauggaagcauugccaaaaaaggaagacugaaaucucaaccuuucagggaguaauuuaucauuuggaugagccuaaugagaaaagcagugcagugaaugaugugacaauaugaaacaacaaaauagugaaugauuaacgagugacaaauugagagggaaaaaaaaggauaacgcuuucauuaugguacaaaagagaauuugacaaacucauccaagaaagcaaccacuuuuuccuccgucuuaguugaacgccuugaaaaacgaacaaucauacugcuuucaaggaauuucauaagaguaaaauaguuaaacuucuauagaauuucaauaauuaaggguuacaaauauauuuaaaggauuuugaagcuuuaauaaucaaaacuuuauaaaaauuaugcugcaauuauucagggcaaaucaaaaugagaaaaaaccguggcauuuugauaaguauaaaaguuauaaaauaaaacauauuauuuguuacaaaugacaauuuaaugaaauauaguuuugcauugaaucuagcuaggaaauuuuagaucauauguuuuauggaauugauuuguauugucugacaucuaauuuauagcuggucaugaauucaaauucuuggcacugcuuuuuucuaacuauguagcuugggaaaauaucuuaaguuuucuaaguuuccuaagauucaauuuccucauauucuaacuugaccuaacacacucuaucugccaaaauuauugugaagaauuaaugagcuaauaucugggacagaaacaaaaaaaucaaagccuaguaccugucacagaacacacauccacaaugucauuuuccucccauuaugucauuagucucaacaaaaaguuaaaaauccaaccucauccaaaauccaaucaaaauuaaucagaauaagagaaguugggcaaauugauuuccauuaacuucaagugcaaaguguuuugcacacuccugggauuuacaugauggagaagaacagauucgaaugaacuuugccuaacacaaauuagauaaauauccuuuuccuugaggacauuaacauuuaguaaacauuaaugaaaaaaaaacaaguaaugcaugccuaaucaugugcuacauaugccuaaucugaauucaucuuuaaacggggaacgguuugaauggaaaauucauguuuuggguuccuacuugugacauguaaugauaauaauuuguguauuccaguaaaauuccaugccuuuugaaaugucucuguaugaauauguugacuaaaaugggucauuuuagaaagacuuaugaaguuugauaacuggaaaaaguccuaagaauggccuaauuuauguaaauaauauacacaaugauaauagaaauguaacuaauauuaguuuguuaauaaugcuuuuauuucugaaaauacaaacaagucuguagagucacaugaacaaugggggaaauauuuuucugacuaugucuguagaacuuuccaaaaguggaaucucuaaguugcuuuuuuuuuuuuuuuuuuuugguauggacuuuuaauuaaugacacccuuguagaaaaauagaauuuaaaaaaggggggugggggacuagggaagggguagcauuaggagaaauaccuaauguggaugacgaguuaaugggugcagcaagccaccauggcagguguauaacuauguaacaaaccugcagguucugcacauguaucccagaacuuuaaguauaauaaauaaagaaaaauauauaagagauuuuaagacauuaaauggccauuuugaauuaacuccuaaaacuaaaaaucaauguccucagcauuuuuaaaagaacaacuauggcagaaaaugagaaacaaaguaagugguggagugagggaugaagauggggcugaguaauagggugauaaauugaaagguuuucaguauggauuugacugaaugaccuggggcccaggucaccugacuccuaaccaaauuauuuucccuguaauaaaaguuuauauucuaagcagagaaaauaugguuggauggauggaugaaucgauagauggauggauggauggauggauuauagauaugaaaaucuuucugaauucuauuacauacuuuguggagaaaauuauuuucaguauuaguuauucaucuggguuguaauagagugagucauuugagcugaguuggaaaauuuuccuuaaacauaaauugccccagacugucauuuuguucucaauguuucauucugcaguguuugguucucucuugaugucaaacugucagaaaucauccuguggucaguacaccugccacagcagucacuucuugucuucccaggggaaacaggauaguauacuuacagagaaaacugaaugaaccuuggaguuagacaaaccucagcuauacccuggaucucccauugugggcuagcuacucaaacuaaaugaagcucucuaucuucaccugaaaaaugaggauaacaggaagugccuguugugugaaucaaguaaacaaaauuuuaaaaauauguaacagaauuccugaaacacauacauacagucaauggaacuuuucuccuuucuacauucucccaugcuguugaaggcaugccuuuguuguuguuguguuguuggagagugcuaaucuagcuugauaagguguuauaugaaauaaugguaaauuggcugugauuggaugucugagaagcucuucaauguguuuacauuugacuguuuuggcugccuacaucuaaguuuuuggcuguuuucugaauaauugagauuuuuugaacaugugaaaugucaccacaguguugcaaaacucuauauucuuuauguuccuguguuaagauaaaaaucucaugugucaaauugauaacccgaguuuuccuacccauguaugucauaagaaaaucacugaaaaagguaaauauaucaauuaaguuauuuaucauauagacuauaaauuuucccagauuguugggguuuuuuuuuuaguacuuuaccuagcauacauuuuaauuuagucaaacugguuucauguauauuuuacuaaacaugcuucagacaugguaccaguucaauauucuaauuuaauuucuauagauuauuaaaaauuuuuaaauuauaccaguuuuacugaguucuguuuuuaauacauuuuaggaauucugaaaaauagaauucccacagaaaggaauccuaagaaaauucaugugaagaaugagaucuuauuugggggauuaauuauaaucuggaaguuuuacuuauaaccucguauuucauauauauuauaagauacuuacauugaauuauagaaauauacaaacaauaauugaaaagcuuaacuucugccucugaagauaugauuaucucaucuccuggccucuuuuguguuuguuuuaaggcaauaaauacuugcuuuucuccuccugaucaugagaaaaugaucuuuauuuaauauaaauuugauuuauauuuuaucuuuuaaaauuauuauuuugguuauaucugcucaauaauagaaaaaaauuauggcuuaacugauauugaauuauuucaaauauuacaacaagaaagcauacagaaaucacaguacagagauauaaaauauguaaaauaaaaaguuuaaaaagauuucaaauguagcagaaaaa

SEQ ID NO: 1200 - RNA, 549 nt, Homo Sapiens
aaauauuucugaauucucuugugauaggucaaaaaauugaggaagacauaauuagcagcugaagaaugacucagaucaucaguagugaauaagaaugauuagggggaaauagagacaguuuaaucaguccgugaccaaaaucaaacagaguaaacugugucaucauggagaucugcccaggaaauccccaaaauacagaaggaucagaaguagauggaaauaaugucauagaacgucucucacaacuguguuauaagaaugacagggaagcuacagguuacaacagauuugugaacucagccaagcacagugguggcagggccuagcugcuacaaagaagacauguuuuagacaaauacucauguguaugggcaaaaaacucgaggacuguauuugugacuaauuguguaacaggguauuuuaguuccuguucuguggaaaguguaaagcauuccaacaaaggguuuuaauguagauuuuuuuuugcacccaugcuuugauugcuaaauguaauagucagaucgugacgcugaauaaaugucuuuuucu

SEQ ID NO: 1201 - RNA, 5361 nt, Homo Sapiens
agcgccggcgaggcgcgggaggaggagaagcaguggggaggcgcagccgcucaccugcggggcagggcgcggaggagggacccgggcugcgcgcucucgggccgaggaaccaggacgcgcccggagccucgcacgcggccaagcucggggcguccccuccccucggccgggcgaacucaaggggcgcagcucuuugcuuugacagagcuggccggcggaggcgugcagagcggcgagccggcgagccaggcugagaaacucgagccgggaacaaagaggggucggacugagugugugugucggcucgagcuccgggcagaggcauuugggcccgaggcccccgcugugacuccccgagacuccgcagugcccuccacugcggaguccccgcgcuugccggcaaaaacuuuauucuuggcaaacuucucuuucucuuccccuccuccucggcccccaucuucugcuccuccuccuucucuagcagauuaaaugagccucgagaagaaaaaccgaagcgaaagggaagaaaauaagaagaucuaaaacggacaucuccagcguggguggcuccuuuuucuuuuucuuuuuuucccacccuucaggaaguggacguuucguuaucuucugauccuugcaccuucuuuuggggcaaacggggcccuucugcccagauccccucucuuuucucggaaaacaaacuacuaagucggcauccgggguaacuacaguggagaggguuuccgcggagacgcgccgccggacccuccucugcacuuuggggaggcgugcucccuccagaaccggcguucuccgcgcgcaaaucccggcgacgcggggucgcgggguggccgccggggcagccucgucuagcgcgcgccgcgcagacgcccccggagucgccagcuaccgcagcccucgccgcccagugcccuucggccucgggggcgggcgccugcgucggucuccgcgaagcgggaaagcgcggcggccgccgggauucgggcgccgcggcagcugcuccggcugccggccggcggccccgcgcucgcccgccccgcuuccgcccgcuguccugcugcacgaacccuuccaacucuccuuuccucccccacccuugaguuaccccucugucuuuccugcuguugcgcgggugcucccacagcggagcggagauuacagagccgccgggaugccccaacucuccggaggagguggcggcggcgggggggacccggaacucugcgccacggacgagaugauccccuucaaggacgagggcgauccucagaaggaaaagaucuucgccgagaucagucaucccgaagaggaaggcgauuuagcugacaucaagucuuccuuggugaacgagucugaaaucaucccggccagcaacggacacgaguuuuauuugggguuugggaccggaucaggccuuaaaucuacgcagaagaaaggcggagaagcagcggaagccgggcacuaguccugcaggguggaaggcgcuuuaucgggucuucuggcccgcugcgggcgauagagcugguaaccugaguagaguaaauagagacacgugggugcuggcuagagaaagcgcggagcagggccgcgcuggagggcuguuugaagccuaguccagagcuggucuagggggcggauggacccugauacccgacacuccacuggucacccuuguuccacaacugggaaacccucuggaggaaauccgguagaaaaguccugacacccgaaugauuuaaccaacgccuuuucccuccaaagaaacuuggaggauauaccuuuuuuuccuuaaauggcaucuuucuacccccaaaaagaaagugugugguuuugagggcggggacauuuuggguuuuaaacagcgcguuuaagaacaccucagaucugccuucucuaucccaauggcagagcuuugaauuaccagcgcacacacauuuguaccauuauugucacaaacucuaaggugauuuucuuucuuuuggguguggggauucaugauguuagguggccagacaagcacaaaccucucaggagcccuaccacgacaaggccagagaacaccccgaugacggaaagcauccagauggaggccucuacaacaagggacccuccuacucgaguuauuccggguacauaaugaugccaaauaugaauaacgacccauacaugucaaauggaucucuuucuccacccaucccgagaacaucaaauaaagugcccguggugcagccaucccaugcgguccauccucucaccccccucaucacuuacagugacgagcacuuuucuccaggaucacacccgucacacaucccaucagaugucaacuccaaacaaggcauguccagacauccuccagcuccugauaucccuacuuuuuaucccuugucuccgggugguguuggacagaucaccccaccucuuggcugguaagaaccuugcugcacccuucagccaggcauuugaacacauguuccuccacuuuccauucauggaaauuagauuuaugaaugguaacacuuguggaguugaagaaauuucacaucaacaagcaaggugcuaacuuuauucagcaaggucagccuguauaucccaucacggguggauucaggcaacccuacccauccucacugucagucgacacuuccauguccagguguuuucccaucauaugauucccgguccuccugguccccacacaacuggcaucccucauccagcuauuguaacaccucaggucaaacaggaacauccccacacugacagugaccuaaugcacgugugcucugcuuuucuccucccccaucccuuccucauuccuucaaccccuuccccuaaccaccaccaccaccaccuuuuaggaagccucagcaugaacagagaaaggagcaggagccaaaaagaccucacauuaagaagccucugaaugcuuuuauguuauacaugaaagaaaugagagcgaaugucguugcugaguguacucuaaaagaaagugcagcuaucaaccagauucuuggcagaaggaaauucaugauuggcaaaugaacauucaguugaggaggaucuaacaacccuugugaaacauagaggaucauguguuagcuauugucgaugauaauuuuaccaggaugauguuuccuuuuguauccaguuugguuuuucucccugugaaggucuguaauacuaggaaguuuuucucucucaucaaccucucucacucuauccuuccuccaacccacccauucccuucuuauuuaaaaaucauuuuaaaaaacaugaacagggagaucaaaauuaauaugcagggcagccaugaaugggaaagaaucucauagccugcaaugggaaggaagcaaaaugggaagcuccacaccugagaguugggggagagcaggagcagggaggcucccagcugacagauugugugugcacacagauacccucauggacagugguucucccaaaucccagaugguucucccuggaaaguucugcuggcagauccuggcauuggggaaguugggaaaauacaugaacacugucugcuggggacugggcugcaauuuaaaaauaaaucaaaguuuaaaugcuuaauauuuucauuuuuugauuuuugaaacauaaaauaugcuauugcuauuuugcuuacuuuuguuuuuuucuuccuuccucucuguuuuaguggcaugcccucucccgugaagagcaggcuaaauauuaugaauuagcacggaaagaaagacagcuacauaugcagcuuuauccaggcuggucugcaagagacaauuauguaagccccuccuccauaccaguggcucuccacucucacucauucgcucuuuugcguucaagaaggaaauguguuuuagguguauauaaugcugguacuacuuauuuuuuggaaguuaaugaacuuuguaauaaggauuucauggauauauugcauuaugaaagcuucgagcuaucuuuuuuuuuuugcuaugggugcuaaugaaugcuuuuaaauaaaauuuuugaaauaaagguaagaaaaagaagaggaagagagagaaacuacaggaaucugcaucagguacagguccaagaaugacagcugccuacaucugaaacaugcauuucauuuguuccuucuugagguggaaaacgaagcucauucccaacgugcaaagccaaggcagcgaccccaggaccucuucuggagauggaagcuuguugaaaacccagacugucuccacggccugcccagucgaccccaaaggaacacugacaucaauuuuacccugaggucacugcuagagacgcugauccauaaagacaaucacugccaaccccucuuucgucuacugcaagagccaaguuccaaaauaaagcauaaaaagguuuuuuaaaaggaaauguaaaagcacaugagaaugcuagcaggcuguggggcagcugagcagcuuuucuccccucauaucugcgugcacuucccagagcaucuugcauccaaaccuguaaccuuucggcaaggacgguaacuuggcugcauuugccugucaugcgcaacuggagccagcaaccagcacauccaucagcaccccaguggaggaguucauggaagaguucccucuuuguuucugcuucauuuuucuuucuuuucuuuucuccuaaagcuuuuauuuaacagugcaaaaggaucguuuuuuuuugcuuuuuuaaacuugaauuuuuuuaauuuacacuuuuuaguuuuaauuuucuuguauauuuugcuagcuaugagcuuuuaaauaaaauugaaaguucuggaaaaguuugaaauaaugacauaaaaagaagccuucuuuuucugagacagcuugucugguaaguggcuucucugugaauugccuguaacacauaguggcuucuccgcccuuguaagguguucaguagagcuaaauaaauguaauagccaaacccacucuguugguagcaauuggcagcccuauuucaguuuauuuuuucuucuguuuucuucuuuucuuuuuuuaaacaguaaaccuuaacagaugcguucagcagacugguuugcagugaauuuucauuucuuuccuuaucacccccuuguuguaaaaagcccagcacuugaauuguuauuacuuuaaauguucuguauuuguaucuguuuuuauuagccaauuagugggauuuuaugccaguuguuaaaaugagcauugauguacccauuuuuuaaaaaagcaaggcacagccuuugcccaaaacugucauccuaacguuugucauuccaguuugaguuaaugugcugagcauuuuuuuaaaagaagcuuuguaauaaaacauuuuuaaaaauugucauuu

SEQ ID NO: 1202 - RNA, 974 nt, Homo Sapiens
uuugcuagaacacugugauagauuaacugcagaauucuuccuguaggauuggggauauaacgggcuucacuaaccuucccuaggcagugaaacaucccccaaaucugauggaucuagagucagggaagucugcuuuuguaccugcugggccccaaaguugggcauuuuucucucuguucccucucuuuugaaaauguaaaauaaaaccaaaaauagacaacuuuuccuucagccauuccagcauagagaacaaaaccuuauggaaacaggaaugucaauuguguaaucauuguucuaauuagguaaauagaagucccuauguauguguuacaagaauuucccccacaacauccuuuaugacuuaaguucaaugacaguuugccuuugguaguaaaggauuuucuccauggccuguauuaagaccauuagaaagcaccaggccaugggagcagugaucaucugcugacuguucucguggaucuuguguccagggacauggggcgaugugccucguauguguuagaggguggaauggauguguuuggcacugcaugggaucuggugccccucuucuccuggauuugcauccccacccagggcccgcuuuuacuaaguguucugcccuagcuugguucaaggaggucauccaacugacuuuauccaguggaauugggauauauuugauauacuuuugccuaacaacauggaaaaggguuuuccuuucccugcauccuacugcuuugaacuuccaaguaugucuacucaccuuuuaaaauguaaacauuuucagaaaaaugaggauugcuuuccuuguaugcacuuuuuaucuugacuaccugaauugcaaggaauuuuuauauauucauauguuccaaagucagcaacucuccuguugguucauuauugaaugugcuguaaauuaagucuuuugcaauuaaaaugagguuugcccacauccaaaaaaaaaaaagaaa

SEQ ID NO: 1203 - RNA, 2017 nt, Homo Sapiens
gaagcuaagcggcgcuggugaagcggcucaucaggucuaucaggaaaccugagaauuggagugagaaucccaguguggaaaaucaggaaagaggcugguaugagcgacagagaagucauucaggaaagagguuauugaauucauuggagaaugaaugcuguucugaauuuguuuaccucaacaaauagcuuacaccuccaauccugucuuggcgugcccugcucagaagacacaagacacaccaggagugacgugaggaaacaggcaguaaagauaagccuuugcgacuggguuacucagacccucccugacaaggaggagcccaucuugagugucccaggagaccuggaccuuguggacauccugcagaauggcauauggauccauuacaaugaugacaucaugcugacugggcaagaugacaagagguugcuauacaccagagggcuugggaagacacaugcccugcagaagaaaaaccugcuccugauuacaaggauaugucgauugcagggaggcagaggaagaaauacaacaggaugucuaucgaacacaacuuuggaguaagaccuugggacccaacuccuguuugcuucauauacaagcuuugagacgugaugaguuugccucgauucucuaagccucaguuuccucaucuguuguugugagggaaauaaugcauggaaagcuuuuaacacaauggcuggcacacagugaaagugcaagacguuaaccauuaucaugagaguuuucaauuggaaugaauaggagacuuaaauuugcaugauuguacuuuuacacuaagccauuaaugaugcauucauuuaguuuucuacucccaaagaacauagauuugauuaauuauaacaagaauuuaaaaauauuuccauuauucagaaauaaccuacagagucuaagccuguccuuuccuuccucccuuuuucccaaucuuuuuuuuuuuuuuuuuuuuuugaaagaaauagcaauuauguagucagauucacuggcucuuucuucuucucccugguaacaggcuaagucuuaaccuugauuaggcagcaucgcaucugaucuaaguucuucccagcuuucagcccagccugcuuccccaggcuucagagcgcagcucugcaccacccucuccaccccugcuuagcaucagaacauugccaaagcuaagcaucuaugcaauguuucuuuugaauaguugucuaccuacuuggauauuuuuuuccuucucccagaggcaaaaauuggaccacuuaaucuaugcuguaggacagucuugccccucagaaaauacuugagcauauuaaguuguuaugaaauggaucugagaagcagaguucugaaccaugcccgugaauuucccagccucaucacacuggcauucuuucauagccccgaaauacuuuccacuugcccuuccuaugaaugcaaguaaagcaaagccucuugacaaagcaaauuaagaguaaucaaugguuuggguuuuuuuuuuaauuauuauuuccugugacucaaaucaaaccuauuucucaacuguaacguacgaaaagagagagaucaaguugacauuuaggaaaauugaacauugauaaguaaauugccuucacucagucucuuagguccucucuccuuucccccuaccccacgacaccccguggcccugcucucucucacacacacagcugaagguaucuuuaaaggguaccuauuuccugcagaucacgcuuauguuaaucucacuucaaguacagaugcaccgaggacauuacagggucagucauucuuauccacaaagcuuuagauuccacuacauuauucaaacuggacaauggacuuccccauuuugugcccagacuugcucacuaauagagugaccuccuuguuaugggugaggauauauuugaugcuaaaacugcuacaaauuuuuaucagcauuuaaucuugagacugugaauuacuacauccugcauguguugguaccuuacuuugauuaaaaaugggauaaauc

SEQ ID NO: 1204 - RNA, 3755 nt, Homo Sapiens
uggcaacccgcuccgguguccuuccaugcuguggaggcucuguuguuucgcucuuucuacugcuuacucuucggguccacacugcuuuuaugagcuguaacacucacccugaagguuugcaacuugacuccugaagccagcaagaccacgagccccagggaggaacgaacaacuccagacgcgcugccuuaagagcuguaacacucaccgagaaggucugcagcuucacuccugagccagcgaggccacgaacccaccagaaggaagaaacucugaacacauccgaacaucagaaggaacaaacuccagacgugccaccuuaagagcuguuaacacucaccgcgaggguccgcggcuucauuuuugaagucagugagaccaagaaccaaccaauucgggacacaauaccaacucuuucaugccaggagaagccuccuuaaaaaauuucggugauuaacagagaucagcagcaacaccuagccaacccacagcuuacuuacagcagacaugugaaucaaucuagccaagacuaaaagaaucacuaaaccaauaugucauccuaugaauaauaguaaacguuugucuuaaacuaucauauuauaggaaaaaaaccugauauaugaaauuacccugugaguuuauauuaaagauacacuuaccuucuccaacaagaguuguaacaauuuuuuucuuauugcaaacaaugcuauggggauacuuauaguagcauuucugcucaacguaauauuuuauuguagcacuguuugcaauaagaaaauaauuggaaacugcagaaacgaucacuaaugagguauggguuaaaaaucuuuuaaguugaaagcaacaaaugugacaauuaaaaggcauaaauuagacauauauuuuacauuaucacaacuuguauuacuaaaugauaaaaaugaguugcaaaauaauauauagaacuuuauauuuuauaaauaugcacaugaaaaaauguuuguaaguaugcacaaacuguuaacaguuauuacuucagaggagugaaaaauagguugaaaaugagaaugacuuucauuuuuaguauacuuaaguacauuuucaauuuucaauuauaugcagugauuuuguccuuuaaaaaauaggauggacuuuuuuaaauauaaggaagacauuuucugugaaacaauaaauuacucaguauauacuuaaugugcaugaaguaugagguaggaauacauccacugacauucuugcauuugcauaccacuuccccaaauaugaacucacuucucugacuuugcuagggcugaggaaucaucauuacaauaucuguaaaacuggauuuauuaagugcauccauauuguuuaugagucauagaaaauauguucauuuuccuauccauguuaaaggcugcuuggaggauugacggagcauugcuuagaaaauguucuggaauucagaugaagcuguguuaguauaaaucauuacugguuaccauauacucacacauacuuaggggauaaagaucagaaauuacuuaaauguacuuugucuucuucaaucuuuccguagcagcacaugggucaaaaucuccugaaaguugagcaggggagcuguagaagaauuccuccuuuucucgcagaugaaaucuuaugauauagcagggguuaccuggccaagaagguaagucugucauccagcagugcuugcagagggacuaaaaugaauuaggauguucagaguuguauguuaggugcugcagaaaggaagaaaagaucucauccauaaaggggucuuugacccuggggaauggcaguuggcaauuacgcugcuucucaguuccauccuguguugccccagguuuacuucauggucacccaaacuuucuuugccaugucuuuuguaagacuucuacuuauuacuauguaucaucaucuuuugguaaauauaaauucuggcuaggagaacuaggacagacaggggagcugucugcacacugugauuaggcaugcaucaauucagagcuccaugcugcuagcuccuguauucugcugagcucccagggaggaaauaggaaaagggaggagaacucaccuguccaauuacaaccuacucugcaguacaaaguacugcaaauuccacacaguggaucucugugauugaaggagcacuuguaaaaucugagacauccuaguuuuugauuugguauccaaaacaaaucugaacuuuuaauuaaauauuguucuuuuuccuucuuguuuccaaaugaauaguuacaccagcaaacuuauuggcugaaaaguuguuuccuacauuugcacuuugaagugcaucagacagugguguguuuggaugugggucuuguugaguuugguuagugaguuauuauugguugggauugcagugguccugccaauggaagagaaguaggugugccgaguacugucauguucaccuccgccuuucacagaggcauauuuagcccucaguugguaagugaacuuuuugacaaagguuuaagaggucguagagucuguguaaaagacaaaaguccaaaagugaagcagaaggaauccagcuucuuauuuaugucuggcaugggaagcuucuggauuugauagugggugcaccgaaauuugcaucccaagucauagccuuugcucugcccuaccuucugguauguuguuuuucaaguuacuuaaccucucagggcugcaacuuacuuauuugaaaaaugaauucuagaaucacagaguuggauacaaucuuaagggccaauuagucaaacuuucuuuccagagguauucugcaugaucugaaaugugucucugaacuauagcuuccugaaauuucauuauucuuguaggaacacagaggagaacaaagaaaauucaaggaacuaaauuccuucuccaccucaaccaccagcauugauacuccaucacuuauguacugcaucaagccguccucagaggugaggaaggugcugucaagacuagaagcaugugucccucucuccauugcaagaugggacauagagaggagaaaaguggcagacagaagucuuagguaugucuuuaucagcagcaugaaaauggacuaauacagggaccaaugauugcaucuaccucauggacuuuuuaugagaauugacugauuuaauaaauguaaaagacuuagaacacugccucaucuauuguaaacagucaauaaauauuaguaucaauuuucauugaauccuaaucaguauaacuauaauguuacauucaugaauaagacaaaggcugggacaaaauaaaugagacacuucacucagaccucgcuaaucucaacuggaaaccagaaggcuagaaaucuuacugaugugauguccagggauacagagcauaugaaggaugcagagagugggucaaauggaaggaauguagcaaaacauguaaacuugaguaaguauuugaucucuuugagccuauguuuuucaauauuuggauuccaacagccagcucagugcugacagagucagcaaguucuuguugagugggauuguguccauaaaauaauguauauaaaauagacaagcucuauagcuccuuucaauuaugaccuucucugauuacuauuuuguugauuguccucaaauauuauuaaauaaucaugcccugaccauaauaaagaagacuucaucauugcugaggaugaauuucacaccccagucuuuaacucuaugcucugcuaucucuuccaucuaaaaauacaaaaacugauuguucag

SEQ ID NO: 1205 - RNA, 115 nt, Homo Sapiens
gucuacagccacaccacccugaacacauucaacccugucugaucucagaugcuaagcagggucaagccugcuugaagacaggguugaauguuuugaaguauuuggauggcaggcc

SEQ ID NO: 1206 - RNA, 705 nt, Homo Sapiens
auggagaugggcagacggauucauucagagcugcggaacagggcgcccucugaugugaaagaacuugcccuggacaacagucggucgaaugaaggcaaacucgaagcccucacagaugaauuugaagaacuggaauucuuaaguaaaaucaacggaggccucaccucaaucucagacuuaccaaaguuaaaguugagaaagcuugaacuaagagucucagggggccuggaaguauuggcagaaaaguguccaaaccucacgcaucuauauuuaaguggcaacaaaauuaaagaccucagcacaauagagccacugaaacaguuagaaaaccucaagagcuuagaccuuuucaauugcgagguaaccaaccugaacgacuacggagaaaacguguucaagcuucuccugcaacucacauaucucgacagcuguuacugggaccacaaggaggccccuuacucagauauugaggaccacguggagggccuggaugacgaggaggagggugagcaugaggaggaguaugaugaagaugcucagguaguggaagaugaggagggcgaggaggaggaggaggaaggugaagaggaggacgugaguggaggggacgaggaggaugaagaagguuauaacgauggagagguagauggcgaggaagaugaagaagagcuuggugaagaagaaaggggucagaagcgaaaauga

SEQ ID NO: 1207 - RNA, 2232 nt, Homo Sapiens
agaaagguccaacagacccuggaacugcagucuaaggugaugaauggguuuguggggggaagaugauagucacagggagcuaugaaggagucucacgugagccaacaguauagauucugaaggcguuuauggcaggagaaacaaaauacgcagggaaagauaaucucaguguuaaagacagauguaugccuggaggccaagacagaaaaugagcugcagagagaacgcaguagccugcuagccagccaguaaagaagugaggcuaguucagcggacucgcgcggccucgcucuuuggacucgucacccuccccucccccucccgccgccgucacccaggaaaccggccgcaaacgcgggcggaccugaagcugguuucauggcagccucaaagaaggcaguuuuggggccauuggugggggcaguggaccaaggcaccaguuccacgcgcuuuuugguuuucaauucaagaacagcugaacuacuuagucaucaucaaguggaaauaaaacaagaguucccaagagaaggauggguggaacaggacccuaaggaaauucuacauucugucuaugaguguauagagaaaacaugugagaaacuuggacagcucaauauugguauuuccaacauaaaagcuauuggugucagcaaccagagggaaaccaccguagucugggacaagauaacuggagagccucucuacaaugcugugguguggcuugaucuaagaacacagucuaccguugagagucuuaguaaaagaauuccaggaaauaauaacuuugucaaguccaagacaggccuuccacuuagcacuuacuucagugcagugaaacuucgcuggcuccucgacaaugugagaaaaguucaaaaggccguugaagaaaaacgagcucuuuuugggacuauugauucauggcuuauuuggaguuugacaggaggcgucaauggagguguccacuguacagauguaacaaaugcaaguaggacuaugcuuuucaacauucauucuuuggaaugggauaaacaacucugugaauuuuuuggaauuccaauggaaauucuuccacauguucggaguucuucugagaucuauggccuaaugaaagcgggggccuuggaaggugugccaauaucuggguguuuaggggaccagucugcugcacuggugggacaaaugugcuuccagauuggacaagccaaaaauacguauggaacaggauguuucuuacuauguaauacaggccauaaguguguauuuucugaucauggccuucucaccacaguggcuuacaaacuuggcagagacaaaccgguauauuacgcuuuggaagguucuguagcuauagcuggugcuguuauucgcuggcuaagagacaaucuuggaauuauaaagaccucagaagaaauugaaaaacuugcuaaagaaguagguacuucuuauggcugcuacuucgucccagcauuuucgggguuauaugcaccuuauugggagcccagcgcaagagggauaaucuguggacucacucaauucacgaauaaaugccauauugcuuuugcugcauuagaagcuguuuguuuccaaacucgagagauuuuggaugccaugaaucgagacuguggaauuccacucagucauuugcagguugauggaggaaugaccagcaacaaaauucuuaugcagcuacaagcagacauucuguauauuccaguagugaagcccuugaugcccgaaaccacugcacugggugcugccauggcggcaggggcugcagaaggagucgacguauggagucuugaaccugaggauuuguccgccgucacgauggagcgguuugaaccucagauuaaugcugaggaaagugaaauucguuauucuacauggaagaaagcugugaugaagucaauggguuggguuacaacucaaucuccagaagguggugacccuagugucuucuguagucugcccuugggcuuuuuuauagugaguagcauggcaauguuaaucggagcaagguacaucucagguauuccauaaaaccuaccaacucauggauucccaagaugcgagcuuuuuacauaaugaaagaacaacccagcaauugucucuuaaugcgaugacacuauucauagacuuugauuuuauuuauaagccacuugcugcgugacccuccaaguagaccuguggcuuaaaauaaagaaaaugcagcaaaaagaaugcuauagaaau

SEQ ID NO: 1208 - RNA, 2528 nt, Homo Sapiens
gcgcugaggucucgccccauaagacuccgccccgccccacgagaccgcgccgccagcaauaaggcccagccccgccuucugcuguugccgcagcaacccagaaagcgucauggcugccgccggccaggaaaaaggguauuugacacagacugcggcagcccuagacaagucaccgucacuuucgccacagcuagcagcucccauccgagggaggccuaagaagugucuggucuauccgcaugcgccgaagagcucccgcuugucucguuccguucugcguuggcuucagggucuggaucucagcuucuuccccaggaacaucaacagcuguaaucccagcuacuggggaggcugcaggcaggagaaugcuugaacccgggaggcggagguugcugugagucgagauuaugccgcugcacuccagccuagguggcaggguaagacucugucucaaaaaaaaaaaaaaaaaaaaaaaaaaaaaauacugguaaggaucaguuuacccuuugucggagauggcaucuaguuugagaguuaccaacaaguuuuuaaaguugcugcuuaauuguaggcacuuuguauguaacuggcagcuaauauuugcucugggaaugcaaacuaaauucuauaaaaaggcaaugaaucuuuugcagaacucugguuuaaaguagucucuccuuaucagagaggcauagguuccaagauccccaguggauggcaacuguggauacuacagaacccucugucagaacacauuucuguuuaugucuuccauccacaaauuuaaugccuuuuuaaaaaucuuaacuaagcacuuaucacacacuguggcugaaaguuuuucaguuugaggugugaugccgaaacuaucaagaauuucuuuuucuucauauuucaggaauaugauucauuccuaccauuguaaccauucuuacaacuuucuauuaagucaagaacuuucaucuuuucaccuaaaggaauaauuuuaugguuucucucuggcauaucugaaucaccagcaucacugcucuugcacuuugcacacaagcgcaccacacuguacaguugaucugaugacuaaaaggugacugaugucuacaacguggagacucuggacaaagggaggacucacauccuaggcaacacagagcaggcagggagguuucaucagacugcccagaacagaguacaauuuaaaaguuacaaauuauuucuugaauuuuccauuuaauauuuuccgacugugauugacccaagguaacugaaacugcagaaagcaaaacugcagauaagcgggggacuaguuuacuaauuugucuucaguauuacuuacaaccaugccucugaaauuuuaaagugcauaugaaucaccuggggaucuucuugaaaugcggauucaauacaaauuaacaguuuggguucaucaaaagaacaccaaagccuuugaaacguagauaaucuuagcaaaauuccacaguagguucuccuuagagcaacgauccaacaacacucacuuuacaagauacuuuuaguauggaauauuagacuaguauuaauuauaaaauaauacaaacugcauaauuaacuacacuuuauuucauuuccuaauugccacggaucagagauuuuucaaauggcuuccuaauugcagaaauauucuguauauauuaccccugggaacuugaauuaucauccuuugaaaacgggaccucuuuaaaagucaaguuggauaacugggcacaguuggagaaguuccuggcaagaaaaaaauuuaaauuaccuaaagaacuaauccauggaacaauucauuguaaagcuggagugccugaaauauugauagaagagguuuacacuuuauuaacacaucgagaaauuaaaaguauccaggaugacuuugugaauuucacggacuauagcuaccagaugcguuuaccccugguuuccaggucuacaguuucgaagucuauuaaagauaacauuagguuaucagaauuacuaagcaaucccaacaugcugaccaaugaacuuaaagcggaguuccucauccuuuuacauauguugcaaagaaaauuaggcagaaaauugaauccagaaugguuugaugugaaaccaacagugggagaaguuacucucaaucaccuuccugcccaagccucugggcgcagauauaauuuaaaaguuaaaagaggaagaguugucccuguuuuaccaaauauagguagugguggcaguucacauagagaaauacaugugaagcaagcuggacaacauucuuauuacucugcuaugaaaccuaucagaaacauggacaagaaaccuugaaaagcaccugucaaauggcuuugaagaagugaugccaccaucucuagccauaauaaagaaacagaaucaccuaguauuggauguauuucaauaauaaauagaguggugucuuuuccauaauuguguuaaagaacauuucuuuuccauucaauuuguuuauuaaacuccuaugccaggcauuguugaaaauacaaaauuaaauaaau

SEQ ID NO: 1209 - RNA, 2164 nt, Homo Sapiens
ggagaaaaagaggaggaauggcaaaggcugauugacuuugucagcuacuuacuuuaaaaaacauuugagaaagccagaaagcagaggggaggaagcuccaccgucaugagaaugggaagcagaggcagcggcagcgugcacagacauccuuugaagguuuguuauaaacacagaaacugaugucugggaaaaggcuggagugcaauggcgcgaucucggcucaccgcaaccuccgccacccagguucaagcaguucuccugccuuugucucccgaguagcugggauuacaggcaugcaccaccacgcccggcuaauuuuguauuuuuaguagagacaggguuucuccauguuaaggcuguuuucgaacuccugaccucaggugauccgcccgccucggccucccaaagugcugggauuacaagcgugagccacugugcccagcccaagcuguacuuuuauuuaaguauaauuuaguuagauaugugaacucacugaaaauguauacacaauuuucuguguauguauaaaauuugauauuuaaauguauuuauggcaagaguaucuguaacuuuuaugaacauaucaaguggacaugaucacaaaacaugcaauuuauuaccauagagcuucagaaauaccccuuccaaaaaguauguauaaugauaugauacuuacaauggaggcaacuaugauauuuaacugucaguaaacugaaagaaaaaaaugacucaaaaaguuuguaaagaugauaccuuucggccaguuggguuauccuucuuguuucauuguuuguccugcuuaaaauugagaaugaacagagacucacugauuucaucuucugaauuugaaaagaaugacacacauugcccugcaauucaggucugacuucagcugcaggaagacagacccccaacccagaacaacccugcguggggaauccuucgggaaaaggcuaagcaaaauacaacacuggaauuuggggaggggcuuggagaguuuguuuuuaaaagucuugagcaauaaaucaucuaaccacaagaguaagaaaauuaguuuucaacuuuaauuucuuuggucuuucaguuuuaacaggcacaccuuuaacauucauuuucgacccacugaagaggagaugagcuuauuggcuggugcaccuugacagcauguagguggaaaacaggacauucagucuuuggugcagagugggagauacuuaugaaccauuuuagcacauuucaggaccauguaacaaaaucaacacugcauugaaguggcaucaggaagauccauccacagaagcaaugucugcuaugcaggaagcagcuucaucaagguggaagcaggucugugcuuccaggcuggccaguaucguucaugaaaacagcacauuguggcugacuaugguuugaagaaacaaaggaagccaaagaaaacaaaaaaugcuaacggagaauuuaauccaucucucagagguggaagaaguuucauuugaauugcucccuguucuuuuacucuucuuucccccgaaagggagugugguagauugaguuuagaagacagcccugaacauguaugguucagcccuuuugcuccauuuugucuuggagaagggcuggauucugugcuauucuccugugcuuuaaguuuuguagcuacgggauuuaucuaacacagccugacugguuuggaaagucugucuuauuuugauguuuucuguuaccuagcccgcuaacauuuuuuucaagaaauauagcuaguauugucucccucacaacacagcggaacauauccaagggacaacaguuuaccugccucccagaaggaugcugaguagccaugucaacucucucaaccaacaacagucaauguagcucaaagugcaggguggaugugagaugagacauuugagagagagugagcaaacccugcuggaauaaagauaaccuggccucauauuaacaucaaaugucuagaauuccaaaaacagaagaucacacaaacuaugcuaacuccgaguggaauuucaagacauuaauguaagagagggugaccaaaccaugcuggaguaaagauaaccuguccaguauuaucccaacggacugcuugacaaaucaugauuugccaaacuuaauucagauggagucuugcucugucaccaggcug

SEQ ID NO: 1210 - RNA, 2708 nt, Homo Sapiens
cugauaagauugauuuauuugguuaagaaauacuuuucuuaaaccuauuuuuaaaaaauaacacucaguauuaccauaacaugcacauuugaaaugugagaacuauaagagaugaaaaucugacaggugcaguuagugaaacacaaagcaggaggaguugaaccaaaaccaucaguuaaacauuuugcauuuagacuuaauucuuuguuagaaagguugggaauaacaugaaagccauuuuaaccuugacaaugaaaggagauuaucacuuaauuauauuucagugacaaacugcuuucugucaaauccagcccacaggacacaaacacaaucuuggccacaccuuggcauuacugguuggcggcauuauuucccuauccuuuugugaaacccauucaacauggaaucaaacaauagcaacucuggcaagaauccuccuauauacacaaugaagaaauauuucugaguuucauaaguuauaacacaagugucacacuucuuuucacagcaaccgaagggcaggaguuaguuuggcuaaagcucucaggacauuauaauggcuuuaguauuuagaacuguagcucaacuagcuggaguuucauuaucuuugcugggauggguuuuauccugucuuacaaacuaccugccacacuggaagaaccucaaccuggacuuaaaugaaauggaaaacuggaccaugggacucuggcaaaccugugucauccaagaggaaguggggaugcaaugcaaggacuuugacuccuuccuggcuuugccugcugaacucagggucuccaggaucuuaauguuucugucaaaugggcugggauuucugggccugcuggucucuggguuuggccuggacuguuugagaauuggagagagucagagagaucucaagaggcgacugcugauccugggaggaauucuguccugggccucgggagucacagcccugguucccgucucuuggguugcccacaagacgguucaggaguucugggaugagaacgucccagacuuuguccccaggugggaguuuggggaggcccuguuucugggcugguuugcuggacuuucucuucugcuaggagggugucugcuccacugugcagccugcuccagccacgcuccccuagcuucgggccacuacgcaguggcacaaacacaagaucaucaucaagaacuggagacgagaaacaccaaccugaaacacuaagccagaaaggacaagcgucugcuguucaggagacgcuugcucaacacuggauuugguaggaugucccgcucuagucaucucacugugcuuuugauuuuugaaaaugcaucuuuuccuguggcuauuaaacuauaguuucuuuccaagacugguaaaccauuuuuaucuucuagucugagaccaaaaucaaucaagacugaauaguaaugacacccauuacuguggaugaguuuucucaauuuuaaaauagcgauugcacagaagugguaaauaaaacauuaaucucuauguaucuuugaagguauuauucauauggagcggaaucauuuggcaaaucauuuacuuauuucagguguuuaagauaaccuaguauaauaagccugaggucuuguugcauauuuauuuaaaaugcaugacgucuuauuauauaaaauaauuacuagcucuuuagaagcuucagaggugaaagguguagacacaucaucuccuucugaaucagagaccucagugucucuauggaaccuuuuucaaaaggcagccacauucagucacgccuucuauacugucagaggcaggagggcgaucuuggguuuuggaugauucaaguagacucugccacacaaacgugcuucugcauccuguguucuguauuucacgggcagcguuucuggcuucccaggcacugagcagccuguggggggcacggcagggcaggacugggguguguggguagauaaccuccugggacggcugccucucuguggagcacacugccagcccaggcgcagcgaccacagagcacauauucuggagcccuucauuuuauuugcucaaugaaaauacuucguccuuuuuuaucagcaauacauauaguuccaacaagaacuauucaucacaaacugccagccuggggauuucuucaugaaauauuuuguauuugcuugguacaugguucaaggaaacucuuguguuugugccaaucagggaaauaaacugaacaauaaacgacacugaaauagaguauuaggcaauauguagcuuuguuuuugcuuuuuuuuuuaaaaaaaaccacugaauuuuuuuccacccacaaacacauggaaagugcagaaaccaguuaaucuaugugauguauuugcauacguuuacaaacaagacaaauuaaaacagaaacauguucagaauuuaaccugauuaaauauuaaguucaguccugagcuuuugauauuuaagacaauauagauaaagcaauagcaaaaaauuuuaauuuauuugauuugcaugcuacagagauuuagcuaaacuuuguucauuuggcuagcaauauucuuuuuguaccuguaacacuuaagauucugauauacaaaauuguaauaauauacugauaauucaaacuugagaacuaaauauuacauucuuuuuacccugugcgaauaaauucuaccuuuuaaaaauaguauuuauaauauuaaaauucauauuuguccau

SEQ ID NO: 1211 - RNA, 98 nt, Homo Sapiens
gauguugaugcacgugacggggagggcauaggagaggguugauauaaaaugcaauuacagccucuuaugcuuuccaaagugggggaugauucaaugau

SEQ ID NO: 1212 - RNA, 1198 nt, Homo Sapiens
aaauaacacuagcauuuugacauauuuggagcugcuacugggccagcucuguuuccaggccugccuuucaaucuuuuccuugcuucuggcaugaguuaccaucucuuuuaagaaauugguuaugcauuugaaaauacacguagcuauacauacuuuaaacauaucauuuagcaaggaugcuccuuaucggaccguugcugggaacagagaacacgacaguuccagacuguuuccaagauuggaugaagagauucaauugacaaugcugugaagagagggauuuggagcuuguugggggagguaguguugacuuccuugugcaaucuaggauugagugggggaugcaguuggaaggcaagagaaguaagacuccuccaucuuccugguccagagaaauuaugcuggaucccccuacccuuaaugagaaaggagguguuuguguuuccagcaucuaugagaucugauugcuaauguagcuaccuuuaaagaauucugcuauuuacaauaaaagugagaucucccuccuccaguuccugccaauuauagaggcaguccuauuucaaaaugccauuaagcauccuucugagcugcggaaagucauaggaccagucuucagccgugcccauuacaguagcagugacagcacaccacuuugcucaugauacggaucaggguuaauuuucaaguuuuggaugguucucccucuuugaguuaccauuuguuucugcuuauaaccuacugaucaugccuuuaguacuaaguaaauauugaaaagggaaagccuuagguggcuugcgaaggcucugauguaaauauguguugcugagacggggaagugaagguguuggauuaugcaugacuuucacauguguucuuauaccacauucaugcccccucagggguuaauuuucaaguuuugggugauuuccccucuuugaguugccauuuguuucugguuacaaccccugaaauaacagcgcucuccagccagagggagauuugccccccuucccccaugcaggagauucuccuguggcggcucugcagauccagggagccccacgaccagaccugggagaaauuuuggaagcugagagcauccucacagcagcaggcagaacagacaagugggccugggucucacaacccuaaggcauugaauuccaccauggaaucagaucacagccagaccuuuccc

SEQ ID NO: 1213 - RNA, 444 nt, Homo Sapiens
auggccguggccaguaccaagagucggugggagacgggugagguacaggcucagucugcagccaagacucuguccugcaaggauauuguggcuggagacaugagcaacaaaagcuucugggagcagaagggaggcuccaagaccucaucaacaauuacggcccagauugccuuccuacagggagaaaggaagggccaagaaaauuugaagaaggaucucgugaggaugaucagaauguuggaguaugcucuuaaacagaaaagagccaaauaccacaaguugaaauaugggacagaauugaaucagggagcuaugaagccuccaagcuaugauucugaugaagguaaugaaacagaagugcagccacaacaaaacagccaguuaaugugaaaacaaggucgacaacuacucaggcagcgucaugauaacgugaacagaagguag

SEQ ID NO: 1214 - RNA, 563 nt, Homo Sapiens
gaucugccagccuuggccucccgaggugccaggauugcagacggagucucguucaaucagugcucaauguugccaaggcuggagugcaguggcaugaucuuggcuagcuacaaccucccccucccagccgccugccuuggccucccaaagugccgagauugcagccucugcccggccgccaccccgucugggaagugaggagcgucucugccuggcugcccaucaucugggauaugaggagccccucugcccggcugcccagucugggaagugaggagugccucuucccggccgucaucccaucuaggaaguaaggagcgucucugcccggccacccaucaucugagauguggggagcaccucugcucugccaccccaucugggaugugaggagugccucugcccagccacgaccccgucugggaggugcuguuuuaggacgugagaguacacccaaaacaaaaauggacagaaauuccagucucauaaaugugagagauccagaagauacuucuacaauuucccuucaguuacauauggacacuuuaauaaaagaauauuau

SEQ ID NO: 1215 - RNA, 4291 nt, Homo Sapiens
uggaucugaaaaaaaggauaugcacucuuaacaaguucaacacccaaguacuauugcaaguaccagcuguauuucauggaaaaaaaaaaaagaauaacucaaaaggcagaacgaagagccuagaggucagagaugagaggcaugaauaauuauucacagguguugaauauaaucaaaugacuugcaacauuuaccacugggauuuuaaaaugugguggaccaaucauucuuuuagucugugcauuuucccauuuuuuucaacaggaaugucuagagacauuauuccuguuuugccacuguauuuuuggugaauguguaguaaguaacuggccucuuuaguaucacaaagcuggaugaagaaaaugugguacauauacaccaugaaauacuaugccgccacaaaaaggaaaugagaucauguccucugcagggacauggaugaagcuggaagccauuauccuuagcaaaguaacgcaggaacagaaaaccaaacaccacauguugucucuuagaagugggagcugaacgauuuuaaauuauauaaauauccuguugcaaauaagcuuccuguguauuaguaugaguaauuauagcccaaauaaauacaaguucaacuguggcuacaucuuugcucuuaagcucaagagcgugcuuuaaguucaauaaaauaauaucauuguucauauuaauguuauuaagguaaacuuauucauuuugugacccugcauuuccuucaauauuuguucuaaaacuguuuuguaugagaguauaagcauaaccauaaaaaccugguuggguaauauaauaaaaauaauguggcaacaauaagagggaacaagauuuugacguuccuuuaaaaguuucuguauauuuuacuuaaguauaaagaaaauuguuaugaaugauaggaggaaggauuuuuguccaccuauuaaaaaaaaacugcugugaagcauaggaaguuucaagcauaaaaucaagcaguagauaaauguucuuugaacuuaugaauuucaaauuauaaauuucaaccaugcuauuaaagauauucaacacaguggauauuccuuuugcuuucaaauuuaucuaaauauaugagacaggcaaaagcucaaugcaaaaggcaugacuuuauaaaauggauccauuuugccaauagcucaaagaauuaugguaauauugugggaacugagugaaaauucagaguagguuuugaaaugugauacaaguagaauuuuaaaaagaaaaaagaaaaaaauuucuguauuuagcuaaaaucauaacuguuuccuuugcaaacugacauaaaaaugaagaagcaaaaugugucuuuaguuauauccaaguuccaaauucaaguuaauuacugcugcuccucacucuucuaccuuuuccuucaaauuuaaagaugggcuuugcagagauuaaagcuucagaaaaaaauaugggaaaauauguuaaaauguugaccugaaaaugaaguggaugacuauaaaacucuugagagaauuagacuuuuuguagcaguuuauuacaugauaauaccuuaaaggagaucacauucagugaccugcguugacagguaauauuuaaaauuaaguauuaaugcugauuaauucaggcagaugggugguagccuaaaguauagacauuuuuccaauauuaauuuugauauuaaauaaaugacaucggcucuuguuggauauuguaaaauuuccuuuacuucaacuguaaaauaauuucaacagugaaagguauaaaguaagaugaaaauuuccaucaugaucuuaccuagagauaacuucucuuuuuuugagucggaguaucgcucucguugccuaggcuggagugcaguggcgugaucucggcucacugcaaccuccaccucucggguucaagcaauucuccugccucagccuccagagcagcuggaacuacaaggcgcaugccaccaugccaggcuaauuuuuguaguuuugauagagacaggguuucaccauguuggucaggcuggucucaaaccccuuaccucaaauaauccgcccgccucagccucccaaagggcugggauuaucggcaugagccacugcgcccugccuucuuuguuaauuuuauauguuucgguuauguaaauauauaacugaaaggguaaauauauauaaauacauauuuacugcacauuuauauugauauauauuucucugcuuguaucuaucuauauacacacuuuauaaauaaaugagucaagauuuuuaaaacaaaauaccaaauuuuucaguaucauuugaaauuuuucaaaauuacuuuuuuaaaauuucugcauauucauucagugaaguugaaugauccagugggcacucuguauuccuucauaaacuguguggugaaugugcguguguguauguauguauaugcacguguuuauguguuuucugggguuaauuuccuuaaaauaaaaaggcaacugucaagacuaaagcuauaauaauuuuuaugaaucuuagaaaauguugaauuuuuagugauuccagaaauugaucucuaucgaugaaacugcuuucucaaauacgucagcaaugggauucaggcuuugcuuacaaugugaaggaaguucuuagucucauuugcacaaagaaggaaggagggcuaaagauaaaaagaacucauagucuuuuccauaguuuugggucauguucacuguaaaaaaaaaucacaagaugccauuuuuacacagccuuuuuaaucuacacauacgacaagcuaauaauuccaaaaaaauaauuucuuuccuuuguagccauuuaaaacuaacagcuagaaauauuucuucuuccaauuauuaaaaauaagcuguuucugagucggugcugacuacauuuacugauugaagcagccaacuccaaauauaccaucuuuuaguauugacacuuaaaauaaaacuucuccccagaaaaagaguucuauaaaugauggcuguagaaauaggcacuguccaggcaguuguuuuguggaaguaguguuguuauuuucugguguuuuccaagucaucucagauggugcgugaaaaugagaugccaaagaaggcuuaaaaaagauacccugcaccagcuucagaauguaagcaaaucuuucauuccagcgcuuaaaaguuuugagaaagcuaaucuaaaguuaaauguuuacuagcaucucuccgauuauauuuuagaaacuacugcacaaaaauaaaacaaauuucuuauuuucucuggguugaaaagugcacauaaaauggaaaaugcuuuuuauaccacuauuuccagcagggauuuuauuuucauuugucauuugccagccugggguauguugggagaaggaacaauugauuuuugaaaaggugcauuugugugaaaaccaaaaauuguguucaacaaauacuacuacuaacccauauguggauauauguguuuuauacaugaguaaaaaaaaaaaaaaaacauacauauauguauggcauauauauauauauauauauauauauauauauauauauauauaugcuauagaaaugccaucaaguuaccaguuuacuucuaaauguaacugcuuaauauaaaauaugcaucuuuuuguaguaccuaauucuugcaauucaguguauuuccuggcgagaggcagagaugaacaacccuggacaguuaccacauauggcucuuaugaguauagacaaaaugaccuacgaaucaagcauuuuguuccacggucucuacuguuagcuguaugucucagaaacagcuucuuucucaagagagaacaagagggauaaugcuggaucuaaaggcaucaucugaagaagacaaagauaucaacaaucgcaacuauuuggcuuucuguccaucacugagacuuuucauaaucuucccuucauaaauaggaucucuugaucagaacagaaaaguugagucuuaaauuuccuguauuuauuucugacugauacugagggaagugcaaauuugguugcuaugauuaaacuccuugauuguucuuaaugggacucuuuuaauaagucaaacauuuuugcaucuaaguauauugaugagcgccacuuuaucucaaauguuuacacauacuagggaaaagcaucugcaguuucugaacucuuugugaaucaguaucacuuuuucauguuacuucagagaucaauauucagugcauugguuuuauuuaccaucuuuucucccaguugaucuuguaaucaucagaaagggaaaaaaaaaucuccuucacaaagcccuuugcgacaaacuuaugu

SEQ ID NO: 1216 - RNA, 3186 nt, Homo Sapiens
ccacaaaugugggagggcgauaaccacucguagaaagcgugagaaguuacuacaagcgguccucccggccaccguacuguuccgcucccagaagccccgggcggcggaagucgucacucuuaagaagggacggggccccacgcugcgcacccgcggguuugcuauggcgaugagcagcggcggcagugguggcggcgucccggagcaggaggauuccgugcuguuccggcgcggcacaggccagagcgaugauucugacauuugggaugauacagcacugauaaaagcauaugauaaagcuguggcuucauuuaagcaugcucuaaagaauggugacauuugugaaacuucggguaaaccaaaaaccacaccuaaaagaaaaccugcuaagaagaauaaaagccaaaagaagaauacugcagcuuccuuacaacaguggaaaguuggggacaaauguucugccauuuggucagaagacgguugcauuuacccagcuaccauugcuucaauugauuuuaagagagaaaccuguguugugguuuacacuggauauggaaauagagaggagcaaaaucuguccgaucuacuuuccccaaucugugaaguagcuaauaauauagaacaaaaugcucaagagaaugaaaaugaaagccaaguuucaacagaugaaagugagaacuccaggucuccuggaaauaaaucagauaacaucaagcccaaaucugcuccauggaacucuuuucucccuccaccaccccccaugccagggccaagacugggaccaggaaagaaaggaaaugagaaaaauccagagguugucauuugacuuaugagucuguuugacuucaggauuugguacaugaaauuucacuuaaucuuuuugauauguauaaaacaaauauucuggccaggucuaaaauucaauggcccaccaccgccaccgccaccaccaccaccccacuuacuaucaugcuggcugccuccauuuccuucuggaccaccaauaauucccccaccaccucccauauguccagauucucuugaugaugcugaugcuuugggaaguauguuaauuucaugguacaugaguggcuaucauacuggcuauuauaugguaaguaaucacucagcaucuuuuccugacaauuuuuuuguaguuaugugacuuuguuuuguaaauuuauaaaauacuacuugcuucucucuuuauauuacuacaggguuucacuguguuagccaggauggucucaaucuccugaccccgugauccacccgccucggccuuccaagagaaaugaaauuuuuuuaaugcacaaagaucuggggguuucagacaaaaucaaaaagaaggaaggugcucacauuccuuaaauuaaggaguaagucugccagcauuaugaaagugaaucuuacuuuuguaaaacuuuaugguuuguggaaaacaaauguuuuugaacauuuaaaaaguucagauguuaaaaaguugaaagguuaauguaaaacaaucaauauuaaagaauuuugaugccaaaacuauuagauaaaagguuaaucuacaucccuacuagaauucucauacuuaacugguugguuauguggaagaaacauacuuucacaauaaagagcuuuaggauaugaugccauuuuauaucacuaguaggcagaccagcagacuuuuuuuuauugugauaugggauaaccuaggcauacugcacuguacacucugacauaugaagugcucuagucaaguuuaacugguguccacagaggacaugguuuaacuggaauucgucaagccucugguucuaauuucucauuugcaggaaaugcuggcauagagcagcacuaaaugacaccacuaaagaaacgaucagacagaucuggaaugugaagcguuauagaagauaacuggccucauuucuucaaaauaucaaguguugggaaagaaaaaaggaaguggaauggguaacucuucuugauuaaaaguuauguaauaaccaaaugcaaugugaaauauuuuacuggacucuauuuugaaaaaccaucuguaaaagacuggggugggggugggaggccagcacgguggugaggcaguugagaaaauuugaauguggauuagauuuugaaugauauuggauaauuauugguaauuuuaugagcugugagaaggguguuguaguuuauaaaagacugucuuaauuugcauacuuaagcauuuaggaaugaaguguuagagugucuuaaaauguuucaaaugguuuaacaaaauguaugugaggcguauguggcaaaauguuacagaaucuaacugguggacauggcuguucauuguacuguuuuuuucuaucuucuauauguuuaaaaguauauaauaaaaauauuuaauuuuuuuuuaaauuagcuguaucugugauuguauuucuuuagucucgcucugcugcccacgcuggagugcaguggugcaaucucagcucacugcaaccugugcuauccggguucaagcgguucucgugccucagccacgugaguaguugggauuacaggcauguggcaccaugccccacuaaguuuuguauuuuuaguagagauggaguuucaccauguuggccaggcuggucucaaacuccugcccucaagugauucgaccacccuggccucccaaagugcugggauuacagccgugagccaccgcacacggccucucuauuuauuucuauacauagcuuuucacauuauauuauguuuauauauuguuuauaucuguauuuccucuuucauuagagaaaagguaguacaucuuauucuucauggugucuacaauaucuggcaguuuuuggaagucaagcgugagcuuagagcauagacuggugggauugucaaagaagagggcaacuggaagagaacugucaguuauuuuuggaucagucuuuaauucaucaugacggguuaggcauuaguuguauuucuugcuaauuuugaagaagacuuauuaacaaauccuacauuagguaaaugguuuugaaaguugaguuaaucauaaugguguuugaccuaggacuauuuuuaggcccuauuuaucuuaauaucgaauaaugaagcagcuucccccuuagauauagacagaaaacaucaaagccaccacacuaccuggcuggauuuauccuaguaauaaaaucaaaacugagc

SEQ ID NO: 1217 - RNA, 13910 nt, Homo Sapiens
agugccaccagcagcgacgacagcauuuauuccaacugaagacuucacucaaagcccggacccaggugcugccaggaagcuccagcauccggagccgcccuagccggcaccgcggcagccacagccugggagagagaaaggaaagagggagggcggcgggaaaggcucggcgcgggaggagggcgggugaggagggaaggagcgagggggagggagccucucuccucagcggugcagcuagucucccuccagcgggcggcgacuccggguucccccucgcgcccucucgcagaggcucgcccccuuccccgcccaccgucccugcgagcgcgggcggcggcggugggcgugugcgcgcgugaaggacgccgccucucucucgcuccugcguucgcaggcggcggcuggcggccggcuucucgcucgggcagcggcggcggcggcggcggcggcuuccggagucccgcugcgaagaugcucaaagucacggugcccuccugcuccgccucguccugcucuucggucaccgccagugcggccccggggaccgcgagccucgucccggauuacuggaucgacggcuccaacagggaugcgcugagcgauuucuucgagguggagucggagcugggacggggugcuacauccauuguguacagaugcaaacagaaggggacccagaagccuuaugcucucaaaguguuaaagaaaacaauagaugccaugaaggcccugauagagacaaaggcaaaaaagaauucaaucaggaaugauuuugguccagauuugggacuaaaacuagauguuucuccuuauuuaccugauaaaggaugauuaagccuuuauugacacaggcacagagaagcggagugcugcuucacaccauauccaaugcuugcugcugcccucaccucuaaaccgucacccacccugugcagugauccuuuccauucucuucuuuguugagccuaaacucacacugaaaaaucugggaaaagagcaucugagacagaguacuaucaagugccaagugaaaggacccaacaguggagacuauccuggcuuccuggaagaugagcagugagccgguguaaaagaagaggaagaauacuaggagaguucagcacaauggacagggccaaggcauuauuaguauauacuaguggguggacaaaaaaaucguaagaacugagauaggaguucuucuucgccucucacauccaaacauuauaaaacuuaaagagauauuugaaaccccuacagaaaucagucugguccuagaacucgucacaggaggagaacuguuugauaggauuguggaaaagggauauuacagugagcgagaugcugcagaugccguuaaacaaauccuggaggcaguugcuguuacaggaauauuccaagauacauagaaccucaagauguuguaucuacaugaaaaugggauuguccaucgugaucucaaaccagagaaucuucuuuaugcaacuccagccccagaugcaccacucaaaaucgcugauuuuggacucucuaaaauuguggaacaucaagugcucaugaagacaguauguggaaccccaggguacugcguucuuuccauggccuggccuagccucacuaagacaaggacuucaggugagauuuuccuagaagaguucuccagucccugcagauggaccacaacuacguugagcucuucacaucuucccgccucaucgcccagagugggcugaaggcauugcaaucagaaagaacaaaagcuuuugacccauacuagcauaaaaccugcucuguuuuucuugauggucaaauuaauuuggcaacaacuugaaagccaauaaaguuuguaaaaacaccugaaauucuuagagguugugccuauggaccugagguggacauguggucuguaggaauaaucaccuacaucuuacuuuguggauuugaaccauucuaugaugaaagaggcgaucaguucauguucaggagaauucugaauugugaauauuacuuuaucucccccuggugggaugaaguaucucuaaaugccaaggacuugcacaggcaauuuauauauuugucuauaucuagggucacaaaaguggcgaguggcauaaccagggcuugaacacacuuccugacucccaauagucucugccucauaucaggucaccccuacuaagcccaggacuguggauuauuuuauuugcugaccuuccugggaauuuauugacugcccauccucacaagcagggguaaaccuccaagaaugggcugccauugauuggauuccauucuuuaggcaaaucaugcccucaagccacugacuucuuggauuauaaaaugauuuuuaaacucugggcuuaguccuucaaguacccucaagggguuagaaagaacuauaaaccccaagauagaaacauaagguaguauuccauaaguucugggauacucucccuuuuguuugccauuuaauccccacagaaagaaugaugaugcaugaaugauuccauucuguuaccauagagauguacuuuaaguucugaauucuaggugauugugaagcgcagcccagaauuauuuugcugguucugccuucaaagaacuuccaguccacaggcaagugaggagcuguuucuugacuucuguuggaaagccgucugccacuuugggggucucaggugguacauggcccugucuucucauacucccucagcuacugcuaccugaagcugugccuaccuacaguggccccugaggacuuaaacaauuuuuuucucacauauauuuagugguacugcugggaaauggaauaagaucuggaaguuuguaagcugagggcaagcccaggucauccuaaaaaccucgcuaaguuuaugguucuuuauuauuucaggucagaaaauuaauuguuuuggauccaaagaaacggcugacuacauuucaagcucuccagcauccgugggucacagguaaagcagccaauuuuguacacauggauaccgcucaaaagaagcuccaagaauucaaugcccggcguaagcuuaaggcagcggugaaggcugugguggccucuucgcgccugggaagugccagcagcagccauggcagcauccaggagagccacaaggcuagccgagacccuucuccaauccaagauggcaacgaggacaugaaagcuauuccagaaggagagaaaauucaaggcgauggggcccaagccgcaguuaagggggcacaggcugagcugaugaaggugcaagccuuagagaaaguuaaaggugcagauauaaaugcugaagaggcccccaaaauggugcccaaggcaguggaggaugggauaaagguggcugaccuggaacuagaggagggccuagcagaggagaagcugaagacuguggaggaggcagcagcucccagagaagggcaaggaagcucugcuguggguuuugaaguuccacagcaagaugugauccugccagaguacuaaacagcuuccuucagaucuggaagccaaacaccggcauuuuauguacuuuguccuucagcaagaaagguguggaagcaugauauguacuauagugauucuguuuuugaggugcaaaaaacauacauauauaccaguugguaauucuaacuucaaugcaugugacugcuuuaugaaaauaauagugucuucuauggcauguaauggauaccuaauaccgaugaguuaaaucuugcaaguuaacacaacguaacacuuaaaagcauacauuuucagcaaccaguggcacauauuugaagugaauaguagcaaauuguuuuugcuuugaaaaucuagccauccuacauccuuuggauuucuucacaaggcaguaauuccuuugaacuacugcuuagcuaauacuagguagugcuaaaagacauguucccauaacuuuuacaacauuuuacuuuuuaucauugauguguucaaacuguuuacaaggagaugcuuauagaugauaguuguacauaugugcaaaaaaaaauccacuugcaaugguaagaaauugaaguauccuuaaaggccaugaagccauaugucccuaaagccuguguggagaaugcuuuauuuuauucuuauuuauauacacuauauuaauaauaaccaaaauguucuaagauucugccauuuuacaacccuggaggaaguaauuuacaaacucacgcugaguuccauucuuuccuucaccugcucuccaauaagaugacuuucugauagacaaagcuuaggguguaauaaacagggaagaaaagaagguaagacuguacuuaaacugaugaagauaagauugauuccuuuucauuuuccagauaaaauuguauuuacucaugaauuuauacaacuuuacagauaagaacauuuuaauggauaaacucuauaauuaccaaguugcaaauauuuagaaaauucuauuucacagguuagugccaaaaugucuucauagaguaggaauaauauuccauuuuaagauuauucauuauugacuuuaauagaguaagaaaacauuauuguuuaucaaagcucuuuuuuuauccaauugaugguuaucuacacauaucacuuauaaacuaaaguuauuuaugaaaagcuaguaugucuuuuucucguauuuggaaugaaaguacccacauuuuacaauguaguguugagaauguggcugccaauaaauuuagcacaaugcaauuuauuuaccuuaaaaaacaaacaaaaacaaaaauaaagaaaaauacugauuucaaaucagacucuuaaaaagcuggaacauuagaccugauauuuuauuaugauuuuucccagaauaaguuuaauuucucuuugacuuucauagaaacacuuuccccuuauagaaauugcacuaucuccaauuuauuucuaguuugaguugaaaugaauauuuuaucagauuaauuaugugucacauuuuugguggguuuucucaauuuuaaaaaagaauucauuuuaaaaaauaauuauuuucagagaccaaauaaagacaauaaaaaugacuaucacauaaaaauccuuguuaaaaaagagaucuuaaauuauguuggcucucccucaaaacuauuaaauuagaaaacgaaacuaaagcuccaguuuguagaggcuguuggaccucaguagacauucuucuuuucaaucacaaaucucucucuacuacuguucucaugggaagaaaacaagguaggacuucuuaucuuucauaguuuaagaaucugacaggucacugauauggagccccugaagaagcacaucaucugggcucagaagauuauuuuuuguuuuguuuuauuuguacuaucuaguagagagcacuuuucuuauucccucuuuccuuccuuccucauuuaauuauucccucucagaauucccauguuguccauuauaaggggcucgcuauuuuuaaccuuuaagaaugucuucuuuguuaagcauuaagauuuccauuuaagaggaucaauuuccuguuguacuuuuuaccaugagacugaaacacacacacacacacacacacacacacacacacacacacacguguuggaagagcaaagagagggaagggggucuuuuuagaaaguggcacuuggcgcuuagcugaaagaucagaacacaucauuccucccugcccacccccauauuguuccaagggcaguuguuacauuauuucaacacuagaguagggcggacugcauuguuuggcccugagaacuauagaaacaacguugcaaauaccaugcccaauguguauuuuagaauuuacucauuuaaaugagugcauauuaccauuccuccaugugaguacucgaguugauaauucccucuaucuuuuuaaacccauaaacuacauuuuuaaaaaaaucaaugggaguuuuaaauuuugacucauguuaaagauaagauucugauaaugacuauauagugacuaauuucauuguuucaguaggaaacaaaucaaacuuucaaaaauguuggucauuucagucaaauuauucaaagauuucauauacauacauccuaaguuaggauaauuauguuaacauuuuugaaagaacagccaauguuuauauugcuuguuaaaauggaauguauugucuaucucaaagauuacuuagcuaaauaauaguagacaaauggagauuuaauuucacaaaauacuucauaacaucacuccuaauuggcaauauagucacaaagcaaaagaauucaaauuucagcaaacaauaaauuacauuuuacauuuuagagcuaacacuuaucacauuacauuauggguuuuuauuuugagauaaguucagcuacauagcauaaacuagguuuuuuuuuauaaccaugaaggacagucuugaauuauuucccccauuaacaaagucuaauuggaauccaguauuuuuucucaaacuguaauuucacuugucccaggacacauaaauagguaaaaauuagaauaauaucgugguagaaguuaauuguccagaacaagugcauuauauaaauauaaugcaagcacaugucauuuaagauuuucuauuagucacauuuuaagaaaaauagaugaaaguauaguauuuuuaauccaauucauccaaauuauucuaucgauauauagucaauauuaaaauuuaaugugauauuuugaauucuuuauuuuuauacuguuuucaaaaucaagaguguauguuaggccuuugggacaucaagugcucaauagucacauguggcuaguggcuaccauauuagacagcacuagucuagaguacuuuuuauuuuaagcaaagugacacuugaaguucuaugcuuagauuuaaguggccucaguuuucacauugaggagcuggugggaggccacaaagaaaguguuucagaaauguuacacacugaguaaaagcuuauugaccacuccugcccauucauuuacuucagaggagaaaugauuccuaacaugacuucaaagaacgggcauuacuaaauuaucuacugaccaaucccucugauuccugaugggcccuggagucuugacuacagccuagagucuccugaguacugccaugaugccaauagcauucuugcuuaccaaaaucuacucucagccaacuaugugucuucauucaggaagaacugcacauagaaucugauuuugaggccuggauuaagcuucaugccauccuuguaucacaggcaauaugucuuucuggaaaucuaaugaaccauaccaaaucugcaugaugaagauuguguaaugauggugauaucaugccaguuauccucaaagugggaauaugaccauuagcuggcauuuuuuaagauuuccuuagaaggguuuaaucaacacugccauuacacauggauuuaacaaaagacuuuugaaaauuuuuuacauacugauuuuagaauaauccucaagguucuauagucauuuuuaguggaagacuuaaaaagaaaggaacaauuuuuacugugacuucaauuucauaguauuuuaaacauauuuuguaauucagaauguuuagcaaucccuauguccuguuucacaugcaugguaacugaugguggguugccuacaggcugaagauuuggagagagccauuuuguuucauaaaucaguuuuuauugcacagaagcagcugguuguauuucaaguuggaaaaagaaaaguaaaugccagaaaaggcaaaggauaaacuuaguaagccauuuauuuuguuuuagaauuguuuuugcaaagcaaauuuuuuuaaaaaaaggucaacaaagugaaucagcacuagcauuuucuugaugguugacucaauguauaauuaacaaauauacauagcagagucaauuaaucauagugccauuaugucacuuauuugucauugcaaaguauucagucauguugucuagauuuacuuuagauggugcaaaauuuccagauaguaaccuauguaaaaggauuuguaauuuccuuguaauuccugccuauuaguccauauucugauuuccuuauguucaucacugauauguuccugaucagggucauugcuaguaguugagcauuuacugguugaacauuguuuaaugguuagauguuaugugugucugcauuuaaaaaaauuguguacauguuauuucacuauugguauuacaauauucauaaccacaugauaaacagaaauguacccaauaauuuccuauaaaauuuuucaaaguccuuuuauuccccugacacacucagggugaauuuuugucuccuuggcaaauaagaaaaaaaaggagagagaccacuggagagauaucagcaaaccacccacaguaaccaaguucaguauuuccucuuucuauauuuugaccaauauauuaagagcaaauuuugucauuauuacuccuuguggcuauuaccugagaucagauaauauaaucucagcucauaaagcuuggccaugucuauacuuaucuuggagagcaauaacaaacuugauuaauuuguuugguuauuuaaaauuccaacuuucauaaaugcucugugauguacucaagacgauuggguugugugauacuaacuuccuucaagaacucagucuguucccuguugucugguucagagguccaccagggcaaaauagaagccuugccgagaaagugaacugucuuacuccuucaaaggaaucagauguugcucuagagaagacuccaggcaucuaccugguugagcucaaaugaggcaagugggagaaaaccucuucucauccucugauugaaagugauacaauuugaauauugguauauugucauuggucaguaauggaaaaaugagauuccaccaguggguuacucuuuucuugucuugguuugcuaugccuuaucccagaucaguguuuuguuccaucccuauggucaucucuaaagcccugacaggagcaucccagacuggagaaaugcagcguaucuguggcccagaauuuuguuugauacucuaaacagcaaugcaaagacugcaaaaucacacuauucuaaacaguuguuuucagcucauuuugaagauugaccuggaaaacauauagauacagaauauauacauuuaaucguugcuugugauucauugugucaaaauaacauuuaauuuucacucugauuaaucuuuauuuuccauuuaaaagauuauuucaggcuacuuaaauacaagaccuugcauucuaauuuuugaaagcgguuguuuucccugagcucucucucaacuuugacaguuugugaaugauaaaaaguuacuagguuuguccuuuccuugauagauguagagcaguucaucuguuuuguaaagguacaguuaagcauaacuauaggcugggcgugauaguucaugccuguaaucccaacacuuugggaggccgagguuggcagaucaccugaggucaggaguuugagaccagccuggccaacguggugaaaccccuaauacaaaaauuagcugggcaugguggcacgcuccuguaaucucagcuacucaggaggcugaggcaggagaaucucuugaacccgggaggcagagguugcagugagccaagaucaugccacugcacuccagccuggacaacaagagcgaaacuccgucaaaaaaaaauauauauauaugaccauaaauugaaaacuaucaucucauacugccuccuuuuaaccugaccuauuuuauauaccuacaauacaguuaauaugcagcagcguagagaacaaauagcauauucauaauuuguaauuuuguuuuucuuuuuacggcacccuuaagucucaguaauauuuuaaaaguccucuauaagccaaaagaacguuguaacauauccauuuauuaaggaguuaggccuaaacauaguaauaguaguccauuccauguccaacagauguugcuguguuucuuucaacauuuuucaaugucuugugaguuuagugaguggguacagcugaguugggguuuaggugauuucuuaugcccaaugaacuaaagguaucaguaaaagauuauuaguaaacaaauuaguuauuuaugcucuuacuugaaugucagucauucauuuuaucucucgucuuugagauacacacauuaaaacuuaugugcauauuuuuuuaaagaguaauuuccacauaauuccccaagaacugaacucaaaucuccaaaaauuuuucagaacucaagcaaccaaugauucacagagcaaaucuaccaaagccccauuuuuauuggaacacaggcaugcucauuuauguacauauuguuuguggcugcuuuuauguugucaaggcagaguugaguacuuucaacagagaccauauggacugcaaagccuaaaauguguaucuggacccuuacaguaaaacaaugacccuggguuuucauggcaccccaaugccuuuuuggugacuugcaggaauacagauuccuauauuccaguuuguuuuuuuuuuuuucuccuuagcuuaagguucguauucccauuugcuucugagaaaguuaggaaaauuuuguuuuauguugcagaugcucucacaacaauaauugugcuggagauagauacaacuuagugaaauuuuccuacagaacuaaaaacgcaaaauugcaucacuccugaagaaaagaaauuuagaguaugaauugaguugguugagaguagaauuaaaaagauuucuagcacuuugagcauguuuuagaaauuugauccuuacauuuaaaauuauguaaaugacaucuuucacuggcauuugcucacauuuaagucaaucuacagcuguuacuuacuaagcuaagaaauaagaagaucccuaugguucugaaucucucauaauauucugaaguaauuuauaucaauugaauuuucauuaaucauuuuaggaaauauuauguuuuauuuuguggcauuauaugacaaugacuuucucaacaauagcucagggaauacgcaaacagccagcucuuuuauguaagaaagccauuuucuaauccccacgcuuuccugaguguuacguauuuuauuucuuugaaaagagagggccuugaguaaaugcuuucguuugcuuuccuuacauauuuagaaauccaagaagggcccuugucuuagucuauuucugucacagagaaauuguucauuccaaaauauccaccuuaagggaagcuagugaccgagauauggagaaaaacauaggcauucaugaccuuuguguuuccguuugacuuucaacaucuguaaccaaaaggucacaaaugaaauauuuaguagaaagugcaauaucaauuuauuaggaguaccuaaaauuauaacucuaaauaauauacagcaauauuauugcucuauuauuacagcaaucaauaauauaauauagccacuaggauacacucgcuguagaacucagaacaaaagauaucaaucuucugccaguccgcaucauuauguguagcagagacuuuacuggaaugagugaggggaaagauaacaaaauguagauuaggauuccacauucuccccugcccaucuucuugauugcucaguuugaagacgaucauugauggacaaauacuuuagaaaugaaugaagucaauagcuaauguuucucccagaaacuaaacaacauaguuuaggggauauuaggccuacauucuaaucacauuguaaggaagugauuuucuaauuuugaagcuucccaggagcagcccccuccaggaacaauuuucccugugaacuuucacugagaaacuauuauaugccauggaggagucaaagaugaauuaaauccaaugcuauccuccaggagugagcuuuguaguuggagagaaaagccaaccuuauagauacaaccuguacauauauaaccuaugcugcauuuaggcagaugauaagcccuaggaauggaaagagggaaaagcucccuuuugccaggaaugaugaaggaaagcuuuauggaaacacaggcuguaugugaaagaugggugaaucuuugcagguagggaagaaguagggggcaugucuggcugagaaccggccugaucauagaguggaaaaaugaaaggcagaggugaaggaagaauacuaaaugugaaaggcugaaauacacagggaaguguugccagugugcaacagaaucucaucucgugcaaaauugaauuagacuuccuuacuccuuccuuacucuggguagguccaugugcagccuuuccucagagcaucuagccugacauacuuggcucaucugcugugcuucuaagccaaauaaaaaucaucaaacacaucgaagauauuuuugggagucaccagguuaaagcaaagccucagucacugaaagcaaaaacugaauuggccaggucuccacugacaaaacagaguaaaugauaguaugacagauaauuucaaguuuuccaagacuccaauuucugaaaaaugucucaugacuccaaaaaaucacguacuuccuaaaauguugccaguggaggaccgaaucaagguuauugcugaccucauuuuuucaaccuuuucaguuauuugaccugaauaggcaaucccccaggauuucugauugaauucuaccugaaaguuuagauuuuaaaagacaaccuguaggaagcuaagucucaggcaacaaaauuuaaaaccaucagaacuuguuucuccaaacaucaaccugcuccugucaaguccuuuuucaucucucccuuuugucccuuuacauacuguuuuguaaguuccuuuugauaucauuuauugcaggcaguauuuuuacauccaucuucaagaaacuugggagacauuuagacauuuaguauguguacuuuuaguugucuugccucuuuauuucagauaaugccugugauuagugaauggcggcauuauuccugaagacaaaugaaggaagauagggagcaagauugacugucauuugaaugauggaagagaaguagaauuacugugagguuacaaaaaucguaaguuagcagacauugagaaaggaaaacuuccuacuugggcuuuucaggcuuaugugacauuaucuggauguguuuucuagucuuuccuaaaggagaaauuuuuauuccuggguugcugaaagcuuucuggacuaaaaggauauaagcagcucaauagcagcauagaggauuagauuaauggaacagcacugcauacaggaaagcuacaucuccaauaguuuaggcugcaagucaguagccaaacacaagagcauguaagauuuggaggacaaaguauaaauauuuuaaguuuacacaaccaagauuauaggcuaccuucccaacuucuaauuugaagagcacugaaaauggagcugugaacacuucauuuuuaaaaccugacaauauggugcuauugacuacuuaauacaaagauauauuacaauauuuuuagguaaauguauuaagucuggccugggcauaaauguacauacagaaaauguuuguagagaauucaucaaaaucaugcccauuugcuguuguagagcuacaguauucuucaaugguggugacugaccagugaguuucuacuucuuacagaugggacacaacagucaugggcugucucagcugcccaaagccugaggcagaccacaugagagcuguggcuucuucuuggauucagguuggauaacccaauucaguaauuaaauauguaaauuuugggggggguugggggguguuuucuaggaacuugaagaguacgugacauuauaaaaaauggguguuggaagacuaauuguagaaauuugaccugagggccaauguuacuugguguaaguucacucagacagacaugucagaacaugcccaaagaagccuauaucuugcugcugggaaauguaaagcaguuggcauguagaauacgauaauaaaucauuuaagaaaccaccaaaa

SEQ ID NO: 1218 - RNA, 90 nt, Homo Sapiens
gcaaaacucacagugggaagagcauaaucagaaaaacacaugagggcaggauauucucaucuuuucaaauucugcauguguaucuauuag

SEQ ID NO: 1219 - RNA, 1381 nt, Homo Sapiens
ugaugccuguugacgucugucccagggacaggggaucccagugggucuggcuugagaugggacaaugcuauagcaagaaaucuguggucccagagucugacaccucagagagaagcagcaugacgucuggaaguucagagucagauauaccacaagaaaacaaaguaucgaaagcgucccuggauacuggacagauggcguuuaccuuggcccaacuugaguccuuggagauuugccugaaagaagcagaagaaaaggcuaaagcuuuaucugaacagcuuucagucucugaaggaacaaaaucaaaacugcuugaacaaguaucccggcuggaggaaaaacuggaggcuguggaccacaaggaagccagugggggaccauaugaaaaaaugguucuugugaaagaccagugcauccagaaauugcaagcugaaguaaaagcuucccaggagcaacuuauagcccagaaacuaaagcaugaaaagaaagugaaaaaacuacagacugauuuggcaacagcuaaugccaucacaguucuggaacucaaugagaagauaaagacucuauaugaaggaaagccagccccuagaggguucccaaacauaauuauuggaugaaugaaugaacaagaagaugacuauggaggauacuugggaucuggcuagcaacaaguauauuucccauuguuagagguaguugggucagaaauuagaucagugcuucucagcauuucucuguucaaugcauacuuuuugguggcacccauaaagaaaucaaaaggggaauaucccuuuuuagcaagaaguauuuagaaaaucuaaaagaacucuuccuccuauucauugggucacuuuucagcccugcaucacuguuuacagaaaaguguuaacaucuuggacucgugaagcaauguuuucacacauucuagaagacagcuugcuggaaggguucuguggaggucucccaccuguggaagaaggugauagaaaaauuagccugauaauggaacugucaacccagguuucccuucagacugagagaauuacucagcugaaagaaguuuuggaggaaaaggaaaggaagauucagcagcuggaagcugagcggaguccccauccuccccaagaggucaaggacccuccaggauguuuaccagaagccccaguuuucucuacucaugacaucccaccuguggucucugaugagaauuuguagauucccaauaagaaaacaauaaaaguuuauuaagugucauccagguaaagucugauaccaaauagucuccuaggugacaaacucaaguucaaguucauguguuugaauguauacuaucauguucguauuggaaggaaacaaaaaaaaggaaauguucaagagcaaa

SEQ ID NO: 1220 - RNA, 3063 nt, Homo Sapiens
augauggagacgccgcuccccaaagcaccagagaaaaggcaagugaccgccauuauuuucuuauuacuacugugggaggcgggcagcgcuacgauuaaguauucaguucuagaagagagggacagcggcucuuuuguggccaacuuagcaaaagaucuggggcuggguguaggggaacuggccgcgagaggcgcccggauucuuuccaaagggaacaaacaguauuugcagcucgaacggaagagugggaauuugcuccuaaaagaaaaauuggaccgggaagaguugugcggugacauagauccauguauacuacauuuccagauguuacugaaaaauccggugcaguuuauucaaggugaacuacagcuccaagauguaaaugaccaugccccagaauucuuggaaaaugaaauccuccugaaaaucuccgaaggcagccauccagggacuucauuuccuuugaaaauagcucaagauuuggacguagguagcaacacaguucagaacuacucaauuagcaccaacuccuauuuccaccuuuucacucgcaaucacagcgacggcaagaaauacccagagcucgugcuggaucaagcgcuggaccgcgaggagcagccccagcucagguuaacccucacagcgcuggauggugggucaccgcccagaacugggacuucccagguucucauagugauuguagauaucaaugacaacgucccugaauuugcucagcggcgcuacgaggugcaggucccagagaacaccccuauagguucccuugucaucaccgucucugccagggauuuagaugcugggacccacggggagcucuccuauucauuuuuucaauacuccaaucaaaucauucaggccuuugaaauaaacucaaucacgggagaaauuagauuuaaaaaggcguuggauuuugaggaaauucaaucuuaucacauggaaguugaggccucagacggugggggucuuucaggaaaaugcaccguagccauagagguaauggauauaaacgacaacgcaccggaacuuacuauguccuuacuuaucagugauauccuagaaaacuccccagaaacaguggucgcuguuuucggaauuucggauccggacuccgggaacaauggaaaaaugauguguuccauccaagaccaucucccuuuccuucuaaaaccuaccuuagaaaauuucuacacuuuguuaacagaaggagcgcuagacagagagagcagggccgaguacaacaucaccauuacugucacagacuuggggacacccaggcugaaaaccgaguacaacauaacccugcgggucuccgacgucaaugacaacgcccccgccuucacccaaaccuccuacacccuguucguccgcgagaacaacagccccgcccugcacaucggcagugucagcgccacagacagagacucaggcaccaacgcucaggucaccuacucgcugcugccgccccagaacccgcaccugccccucgccucccuggucuccaucaacacagacaacggccaccuguuugcccucaggucgcuggacuacgaggcccugcaggaguucgaguuccgcgugggcgccucagaccgcgguucuccggcuuugagcagcgaggcgcuggugcgcgugcuggugugcuggacgccaacgacaacucgcccuucgugcuguacccgcugcagaacggcuccgcgcccugcaccgagcuggugccccgggcggccgagccgggcuaccuggugaccaaggugguggcgguggacggcgacucgggccagaacgccuggcugucguaccagcugcucaaggccacggagcccgggcuauucggcgugugggcgcacaauggcgaggugcgcaccgccaggcugcugagcgagcgcgacgcggccaagcacaggcugguggugcuggucaaggacaauggcgagccuccgcgcucggccaccgccacgcugcacgugcuccugguggacggcuucucccagcccuaccugccucucccugaggcggccccggcccaggcccaggccgacucgcucaccgucuaccuggugguggcguuggcuucggugucuucgcucuuccucuucucggugcuccuguucguggcggugcggcugugcagaaggagcagggcggccucggugggucgcuacucggugcccgagggccccuuuccagggcaucugguggacgugaguggcaccaggacccugucccagaauuaucaguaugaaguuuaccuggcagaaagcucugagagccaguuaaaguuucuuaaaccgguacuucccaacuucuugggugaagggacugguggggacagcgaggcaaacuccaacucuaggaaucauuuuggguucaauuaggaaucugacaacaggucgugauaaaucauagaauucacuauucaucuguaaguucccaauucucucauucgcguagagucacauauucacacauuaguaauggcugucauauuuauagcuauuucaaccugcuggacuauuuuccauucccuuuaauuuuuguuguggugguugucagcuauguuaguuacagcaugugcacacaauagcagagaaaugguguuuccuaugguuguuguuuuuguuuggucagauuuuggaacucacagguguuuucagguucccaguauuugaacuuguucauugauauguuaugauuaagagaauaguguuucaaacuuucugguuaucaucagcaugacucuaagucuaucguaaaucacagcuuuuagccuaaaaaauaauuuucauuuaugcaaaaauuuuaguaaucuuguaaauuguugcacuucuguuguguuguuucaaaaacacuacucuucccucaaaugaaccaauauuuuaccuaggugauguuuucucuccugaauuucuuuuuucaaaauugauauuuauagaccaucggcuguuauucuaaaggauucaacuccuguuacaugaaagaauaauagaaaaaagguugguugacuugugauugcuuuuuuuuuaauaauaaauggcuuugguaugu

SEQ ID NO: 1221 - RNA, 152 nt, Homo Sapiens
auuuuuacccggcaggaguuaccaugaucacgaaggugguuuuccagggcaagccucaaccauugcacuccggauaugcugacccgcaugauuuccccaaauguaggaaacucaacugcauaauuuuugaaggacugcauugcacucucuuc

SEQ ID NO: 1222 - RNA, 727 nt, Homo Sapiens
ugcacacaucuucuucuccaagguuugugugcagaacauccugcccaugcugcccuagcagcuucaguuggcaccugccucaguccagccucugggaaccaugcagcagcucccagcggcccugcacccaccaccagcauccguuucaccugcaguugaagauccgugaggugcccagaagaucaugcagucaucagucccacggagcagccugcgaggcugaggcuccucccacuggaccgccccccaacuggcaccacugcugccccugccccuacucucagccucacgugacucucgggcagaagcagugguggggcagccagggcagcgucaagagucugagccagcugcaggacaaguucgagcaucuuaaaaugauucaacaggaggagauaaggaagcucgaggaagagaaaaaacaacuggaaggagaaaucauagauuuuuauaaaaugaaagcugccucugaagcacugcagacucagcugagcaccgauacaaagaaagacaaacauccugauccauaugaauuccucuuauuaagaaaaauaaagcauccaggauucaaugaagaacugacuaucaccuuguuaaucauucagaaacauguugcaggcuuaagccauuuuugauauagauacugaaacaauuacuugcuaagagcaaacuugaagguauggauaaggcccugagucaucuuccugagcugaaugauaguuaagcu

SEQ ID NO: 1223 - RNA, 79 nt, Homo Sapiens
ccgggacuuuguggguucugaccccacuuggaucacgccgacaacacuggucuugaagucagaacccgcaaaguccugg

SEQ ID NO: 1224 - RNA, 128 nt, Homo Sapiens
aucuacagccauaucauccugaacaugcuugaccucaucugaucucagaugcuaagcaggguuaggccugguaaguacuuggaugggagucaugucuuaauucuuugaagaaugcuucauuauauuug

SEQ ID NO: 1225 - RNA, 2025 nt, Homo Sapiens
agugcaagagcagugauucugggauucagauaugccaaagagaagccaugaagugcaucuuuuaaauuaaaagucauaugcugagguugcuaagaucuauggcaagaaugaaucuucuaucugugaaacugugaagaaggaaaaugaaauuuaugcuaguucugcugcauauauaggguucaguauuaucugcaguuucagccuaccuauucucccagagggcaugcauucuauggagacagagcugaaugugugccaucagaagaccaaaaucaagcgacauuuuaaaaagaaaacagacucuucugggaaaaauggugacuccacaaaguaagaagccaccaagacuuguaggacauuccuucaucuucuccuggauggggcaacccagccauggauauaugccuccaaucagcauaaaugcccauugcuugauaaagucaacacacguguaagaugguauguagaucuucugggcuccuggccuuagacucuugcccuuguguuuaccaacucgauuguaaauccuuugagggcagaaaccauauuuuagauuucuucauauccuuucccuuccuccaugucacuaacacuucauguacucaacaaaggucaacaccuuugagaggagugacaggagacacucccacagugcugaacuauguccugcccuugcucaacauggugggacucugccucccaauccaaagaccccgaaaacugccaccaauccuguccuuuucccccaaaugaagcuagaaguaagaauggaaagagaucuaaacaccauccagcccaaucuugucauuucacaagcauggaaaccgaggccacagaaaagaauugacuuaaaaucaagaucaugcaucccauuagaggaagcucuaacucuagaaucagauaauaugacucuaguucaauguccauaagacucuauugcacaauuuuuuuuggcaucaaguaucuaaagauaguucagucagaagaaccuggaaccuagagaagccaaggguuagaguguagguggcugagaucucuuacugccccuccaucugcucuaggaaauucuguuucuugaagggaacuccucagagaaaaggaccacaagcaaauugcugcugcuacaaaaugauaccauaaugagaauggaaauaauccuggauucucugcucauuucgacaaguaaaauaaggcacauauuuuucaauggauaauguucuuuggucucuguaaaaauuguuuccguuuugacacuuuuuguaaccuauuucuuugaaaccugaguucacucaguuuggggaaacauaggguacggaagaagaaggggaaaaggaauauggaaucacaaggauuuagagucaaaguaauuuuaacuuucauagagagaccgcagggaucagcuaacacaacaagcccauuuuacagaggagucaacuaaggcucaaagaauccaugagacucgcccagagaagcagcucauuaguggcagaguugaucuagaauucugggcuccugcugcugcaacccaguccucuuugcagcaucccaaacucccucucucauaauaauccaggauaauagucauuucccauuuuuaauaagaaggaaaugagcacagagagaaccagucacagcaugauggaagaaaccuggaacuaaagccucacuacuucucuuuccugacugccccgccaccucagaucccaaauccacagcuuacaggaaguuuuuaccaauguuauuucuaagugagcacagaauguacgguccaagccagugauaagaauucucccuguagccugggguuauuguaauuaaagugcauaacuuauacauauugcagguaucugucacaucaagcaagguuugaagaagaaacaacuggagaauuuuacuuauguggaugaaaaagcaaacagaaguuaguccagcauggaagucacaugcuuugggauuguagcauuguguucuccuguaggaggugauccauugucauuuaucggaauccaucuucacucaaaagga

SEQ ID NO: 1226 - RNA, 3762 nt, Homo Sapiens
acaaacagcugaagaucugccuggacccccuaccccucucuuuuuuccuuguggaaacuguguauaauuuggaaagagcaaggacauccuggcucgcagcuggccagcuccaccugcgaccuggacagccucgccccucccugcggagccaggcgaguucacagggcugccuccgcuucuugcagcaugucugcucuccuggccuggccucuccagaccuuucccuccacgggcagcgauuuccaaggcucucaagacuccaaaccacgucguuuugggagugaaaaagugaaagcacacaucgugucauuagagcagcagggaccagcugcugggucaacacuuccgaaaacagcgcuuccuggggagcgaccggagcaucucagaaucuacgguuugaccuccugccaauucucaugaacgugcuucagaguugcacuuagccuagaacauggccugaccucuaugguaugaauaaaugagcuccaugaagacaauaagaucuccugaaauuauacagacagcaaaguaugucgcugugcuuccuugucuuccugugaugacccaugugccaucuuacacaaauggacaaucaauggaggaccugugaguguuguuuuccugagcuucuccucugucuccucuuguggcugcacuugacugagcauuucaugaaagaauacagaaugcacuucucagacuacucuuggucaguccuaagcagcacaaccuuagccacuguggagcuagugccagcugugugaaucuguacaguggugcaguguuaagggcaaagagcacuuuggagccaaggcagacaaaacugcgcagagcucccaggccugggugaugaucccucuucccagacaucugaggaguugccauauugauguucucucauuguuucggcugagcuggaaugaucgaaauaauucugggacuaugacaagucucaccagaccucguuauggaucagggagaguacuuugaaaauacauauuucacauuauaauagaauuucauaauuuagaaaugaaaaguacaucacucuaauuauauuucucuugaugaaaguaaaauuugacaaguuaucucugcugacaagaaucugcaucagugaaucugcaaagagggcaccaguuagggguggggccucaucuuccuagauggcucaggucuagagccuguuggcuggucagacauaacauuuuuauguuuaucaaauaggaaaaugauuuuuuaaggaccaucugggcacagguaacaggagaugcuuguaucucuccuguagggucagucuucaggagacggagcugagacaggaguccuacuggcaagcagaggagcccugaguguggcccugaugacaagcagcagggaaaccaggacuucaguccuacaaccccaaggagauggauucuuccaacaaccugaaugagcuuggaagcccccagauaagagcccagccagccaauacuuucaugucagcagcguaaaaccuaagugaacagcucagcuaaguccacccagacuucugaccuacagaacuagaaauaauaaguggguguuguuuuaauugacugagugugggguaaucuguucugcagcaguguacugacaauacagcacaaaugcacaugcaugugcacaugaucuguggcugcuuucacgcuacaccagagaguugggucguugcaguggagaccuuauggcccaugagccuaaaauauuuauuacugagucuuugagagaaaagguuugacaaacuuguucucuaaccauagaaguaaucucauaucagauguauuuugugaagguuuugugccuuacccaaggcuugcaagaaacaggacuuacacccaggcacacucagcaaacauugcuucugucaagcugaauuagcuccaaaaaauuaguaggcaccaggcugacugcagaccuacucuccauuccaauuuuuaaaauguuagggggagaaagaguguguguguguauuuauauuguugagcagggauaaaaauaucagaggaauauguaccauauguauuuuagagguugucauuucuauauuaugaauuucaauaauaguugaauuucgugucaugaauuuguguuaguaauuauuaccuuauuauuuuuaaaggcuauucugugcuccaugugugcuccuuggugcaguggccuagagaagagaaguggcaacaaugggcaaaaccuugaagaaaguuaaugagcuuaagacagcaaaaguggaaaaaaaaaucucucuagguguuuaauauuugaagcugguaaaaucuuuagacuguaacgcaaaggcuaugaagaaguauuguaccacccacagggugccucaggcucccucuccccucucgcuuccacaugccugucacauucuauuuucagggaaucuuucauucauucuuucagugccuauuuauuuggcaccugcuaugguacuaggcagugugcuacgugcuagagguacaaacagaugaaauacacagucacuauccucauggugccccucaccuagugaagaauguggugacaagcaucaugauggaaucgaggucagagccaaaauaacugaagagaauuuccuggugaugccuugcuucaggcccuaauauccaggguccaggcaccuuuucuuccuggaauggcuucugcuacaugugucaggagaaccacggccugggagagaaucacaugguugcuucuagguucaaaugagcugcagucacuuccccagaggauguagagcagcauaagccugcugggcagaggggggguccaggucccacucucuuguauccggggaagcacacaaagggucuggaggacacugcaugaauguuucugcgugacuggacccaucugcaggcaauuuaacaguugccaaaguuucuucaucagugugcagucuggagcacccaaagacugggcagggcugaucugcggugaccaaguucagaggcacaggaaggcacaguuugccugaacaaugcugagcgugcuugcaagccugagagaugcaauuauuugaacgcuauuauaugcuggccuuccggugagcuucaagggagcagacacuaaggucucuguugcacucucugagccucaggccacaggcugccugugccuuucauguuccuucaguggccaagggcaggucaucugggaaaugaagggaugugaggcagagaugauucuaggagaggguggugcauuucccauuuuguucccaaaguuuggguucuuccuuuagcaguuucacaguagacccaguuagugauaccauguccagcccuucucuucuuaucgaucuugcucagggcagcaaugugcccaguuaccuacuugcuuuccuaguuucucucacugcugcugguagcuugugccauaacccaagccaaauagauauaaacuaaagucagcuugggacuccugagaaaguuuugcuuaugugauaaagagggcccaugugucuggcacuacucuuccccaauuucuuuuugccuuggacauggacaugaugucuggaaagcagcagccaucauguagccaugaggcaacaaagaugaagacaaagcuuagacuggaagggagguaaaguagaaagagccauucauuuauuuauucaacuaguauuuauugagugucuguuaugugccaggcacuguucuaguugcuagagacacagcagugaaaaaagcacacaaaaucccugccuccuugguguuuauuuuuagugguaac

SEQ ID NO: 1227 - RNA, 944 nt, Homo Sapiens
aaaguuuauuucuccuguggaauauuucuacgugguuuccuaguuggugaauggcucuccuugccaugacucagacauccagcuuucuuccaucugggaguucugccauccccuagggccuugaugucacuuauauccagccagcguaaugggaaagggaacauggaaaagaaauaaugacuucuuaaaagccauggcucauugugacacgucacuuccgcugacauuccauugguaaguacuagucauauguccacaccuagaugcagagggugcugggagacacaguuccuggccagacagcugcuucccagugacaaaucuacuuuauaucaagagugaaaucauccagaauagagugaauucgggcuucagagcggcuguuuaggauucagagcucuaccaacaugagcaaucuguuggcaugacaggucagagaagccgugaaggacauggaaggaaguagauggaacuggaaacaggaggccaaccccagcagucaguggugcucagaaaaaaauaagacacugaaauuugaggacuuaauggaguuuggugccuucaguuagcugaugucuaugaagccugaccagucuacuucuagucuauaagaucauguggaagcuucagugacaaacuucuacuuuacuaaugauuuuaugauccuguuacccauugcaauugcuuaaaugguauuuuaauuagcugcuuuaaaugacuuugcuuuuuuacaaaaagcagugugugcuuuaguuuaaaauaugggucacugguguuucuuucuagaagaugacuguguuuaguaccagggaaaauuggugauguauuuggagagguuuuaacuucuguaacucagguugauaucuggaaugugaguguuuccauacuuccguggaugcagcaaauuuauauaaagcguuauuaaauuuguucuaguuuuuaaa

SEQ ID NO: 1228 - RNA, 3436 nt, Homo Sapiens
ucaaugcacuguucaaggauguuugagagauuuucugucuugccugaauacaaaacacuguagggaaccucuuugugcuugacuuugcacacacacgggaucuucaggguggguacauuuaaaacugacaaguauugccaaauugccccccaacguaguuuuuacaccccaccuacuacucucagugaaaaaucaggcccuuuuuauuuuaagggcuaaauugcuaaucccugugugaaaauggguguuaacaaaauaaaaaauaaggaaaauaugcaggcuuacccaauuuuguuaucuauacauuuuacagucucuaauacuuagcauagcuccuuugggugucugcccaccacccuucuuucugaacgugggguucccugggcuuuccuuguuugacuucagaccuggaucuaauagggaucuggagguagaaucaagacgaauguucccuuuggccuuaggugaguccuuugcaucucugaggcccuguugaugacauccaguucucuagaccucugcccaaaccagagcaaucccuccucaaauaugcuaagcagaaaugcagacaauauaagacacacuauauuuauauuuuaggaguuuacauuaccuucccuucuguuuggaaaccaacaucucucaaaauuagguauaguuaacacagaauaccccaaaauaccaccauucuucauaauuccauuuccuuauuucuggauucuuucaaggguaaaaaccuuguuucauucaucuuuggggcagcauuugccuaguaugugguaggcgcccaguagauuuuggauaaacugaccugauuuucuguuaauauuccaacuggauuauuucuuucuccucuuacagaaugaagauauucaaauguuauuuuaaacauacccuacagcagaaaguuuucauccuguuuuuaacccuauggcugcucucuuuguuaaagcuucuaaaugugagacgacucuuuccgcaaaaagacauuuacuugguugaguacucccuaaguaccucgccuuuuguaagaaacagauacacucauguuaaggaugaagucagguaugaaguuaacuguucggguaucuaugaacaggagccuuuggaaauuggaaagagucuggaaauaagaagaagggacaucauugacuuggaggaugaugauguuguggcaaugaccagugauugugacauuuaucagacucuaagagguuaugcucaaaagcuugucucaaaggaggagaaaagcuucccaauagccuauucuuugguuguccacaaagaugcaauuaugguugaaaggcuuauccaugcuauauacaaccagcacaauauuuacugcauccauuaugaucguaaggcaccugauaccuucaaaguugccaugaacaauuuagcuaagugcuucuccaauauuuucauugcuuccaaauuagaggcuguggaauaugcccacauuuccagacuccaggcugauuuaaauugcuugucggaccuucugaagucuucaauccaguggaaauauguuaucaacuugugugggcaagauuuuccccugaagucaaauuuugaauuggugucagaguugaaaaaacucaauggagcaaauauguuggagacggugaaacccccaaacaguaaauuggaaagauucacuuaccaucaugaacuuagacgggugccuuaugaauaugugaagcuaccaauaaggacaaacaucuccaaggaagcacccccccauaacauucagauauuuguuggcagugcuuauuuuguuuuaagucaagcauuuguuaaauauauuuucaacaacuccaucguucaagacuuuuuugccuggucuaaagacacauacucuccugaugagcacuuuugggcuaccuugauucggguuccaggaauaccuggggagauuuccagaucagcccaggaugugucugaucugcagaguaagacucgccuugucaaguggaauuacuaugaaggcuuuuucuaucccaguuguacuggaucucaccuucgaagcguguguauuuauggagcugcagaauuaagguggcuuaucaaagauggacauugguuugcuaauaaauuugauucuaagguggacccuaucuugauuaaaugcuuggcagaaaagcuugaagaacagcagagagacuggaucacuuugcccucagaaaaguuauuuauggauagaaaucucacuaccacaucaugauaguaaaaucaggauggaaauaagagggugccugauaaauggagucaguguggaauugaauaccauacuaugcccaauacuguuuaaacucaguccucccauauuuuaaaagguguccaaaauuccauacacaagggaaagugaucuagccuuugauguuauuagccugcaguuggcuagguuuuuuuaauauuuguuuuugcuuguaaucucacugagccaaaucagagaucuuaaacauucagucagucaucaaacauuauugagcaccuaacuauaugacaggcacuuuuuuagagacugcggcuuauccucaucauagcaaccucgguaucuuuaaguucuccacauaacagucaggauucuacugaagaagcuuuugaaguuugugguaaucgucugaucauauaaaccacccauuucagaguaguguuuaaguacugugaccaacacuccacuugucucuuaacucagcuuucaagacauuucuuaaccaucagagcagaggaggaaagacucacuaccucagaaaaaucucaaagaauaguccaauuuccugcuugccaaagcauaaucugccuuuuggugcauuacuuggucaauucaggguugaggagacuguuggggggcauuuauaauguaugaaaguuaaggaagggggugaggauguggguugggacagguaguaccuaaagaggagcgaagggauuuauacaacauuuuuaucauguuacaaaacaguaucaugaauggccuccuuuuuaguucaacuguuucuuuaaaaugcauuuacugauuaaaaauaagaacugaccaauagcuccaagugucacacaccagaacauuaagccuaaguccucaauucauaaguuaucauucuagauaaguuucuuuacaauggaauacuuucuguggaaucauuauaauucuguuguauggaacuaucaagcuaagagucacuaaacuuucuucaaaagguugugugaaauaugacagcuuucuaaauuaauuuguauagucauuuaaaauuuuuucuucucuggcaacuguccaacuggaauccagauuuaaagugauaaaagcucuaaguuucuugcagucuuuuucucagcuuaguuccagagagaaaaaagcuaauuuuccuaaggacacagcaagaauauucauuaaggauauuuucuaaaacccacacuugagaaaaccacccaauga

SEQ ID NO: 1229 - RNA, 794 nt, Homo Sapiens
gcccggcuucgugacgcuugccuuucggagccgcuugccgcuucuccgcagcccuggaccagaggggacaagcgaugcugcccgagcccccgccccugggcuucgggacagggacgcggggcgccugaaaggacugcuaccgcggcuucugcgccagggcaaccggggcuggagggggccuccgaguuguucuuugggggcggaagcugcgggccgcgccucccaggccgcgcccuucccagagaccaguuucugggcuuuuuaaggucaaguuuuuugugccgcagagcgggccgggaucgucugccugcgagguggcggugccuaccacagcgggucgggagcuucugggauccgagccgagaaacgggacgcucgaguccauuugcagucuucacguaggaaacggugcuagaacaacaaaccagaagauuaacagaguuggggcuaauauaaugcguuuaauugucucaugggcccauguucuagaacuacauccucggucacugucccaguacagccaucuguagcaccuccucaguaacugacggugauguuccuuucccuacgcuguuuauaccaucagccugggguuuucuuuggaggugacacaaagguaaguuucaguuuauuuauagucagauuaagaugaauucagaagcuucagaauaauaggaagcaaaaaauugugccuuguaauuucucucugcuuuaccuaccucccccaagcucuaaaaccuaagaguuuugugcuaaagucuagauuuaaccaagagauucagguuauuuaauuu

SEQ ID NO: 1230 - RNA, 6102 nt, Homo Sapiens
agacugcuaccccgccgcgcucgcggccgccugcguccuccucagcagcccugcgacaagucccggcuccugcugcgauuauauuauuuuuauuuuuaauucacaauuuccccuggcccucaaagcguuuuuuuguuugcgggcaagagggaguuagaggaggguaaaaaagacuuugaaugugaggcaaagauggaggaaggcguccaggccccagacugggacagugaugaaacugugauagaggguucagugacggagagcgaccuggaagaaaaggagcugcccuggagaagguugcuguuugaucaagacgcaucucuuaaaucugaguucagucugcauccugauacaagaggaaugugcaaaggcaugccuucuccugagauucaacuuggauuuaagcucagagaggaucugcaagagcaaaugaauaaaaauaagaugaugccuguucuuagcgaggauacaauauuacagucucaagaugaaacagaacgaaaucaagcucuguuacagacuagaaaaaacuguucaauguucauugggucguuucgccagucuggacuuucauugaaccaccaaaauauugaagggccagaggcugaaaguccugaaguuuugccacacauagaaaaggaacuaagugaaggcagagauucuccugaaguuagccuucucucaggcacugcuauuacaguaucugauacaguugcuguaaaggagacaucauuaguagagccagagaagauuuuagcagcaccaaauacauuuuuugagccuagaaaggaagucacaaugaccaugacuucugaagaaacuaaggaugaagaaagcucucuugaaaccuuugugucugccuuagaaaguuuacuuacaucaccagaaagcacccaggaggaaagauuguuugaauuaguaagugauuuugaucguaaagaauugaugaacccauugagugacucucuuaguuccauaucaauaccuuugaauuccuggucggcaugucauagagauuuacuagaagaugcaaaagaugaugcauugccagcugaguuauuggaagcccugaacacauugucagaagccaagguggaaaccaucugucacagaaaagagggagguagcagucucauugccagaaaugaauguuuagaaguggaguucaauacgucucagaccaaugaagauuguacacaaauagcagagacucugcaagacccaaauccaucuggauugcaaacuuuggcucaucaaaauaucacuucuugugagccacuaaguaauaagagaaauucaaauucagugacaaauagcucugaucaggaaacugcguguguguugaggagaucauccagacuagaaaaacugaaaguaagcagagaugcaaaguacucagaucacauguauaagaugccagaaaagauuuuaccaaaaauccuuggcugugaggaccuaacaaauaauaacucuucagcucagaauuucagaaugcaggauccggcuuuaaugauugaugguaaagagaagaauaugcauucagcaagguucaagaauggaaaacagaucaggaaaaaugaacaauuuucaggaaaaaaagaaaaaaugaaggugaacaaaauaucucuucauagcauuaaccggagaaacauuuuuggagagaacuuaguauauaaggcugcucuacacgaugaugcugaucuuguucaucauuguauaaaaaaagguggaaauguuaaucagccaaguuaugcugaagaugccaaauguaaacaaaugccguaucuuuuuguaugauagguuggacagcacuucaugaagcuaguguaggaggauuuuaucggacagcaagugaacuauuaaaagguggagcagauguaaauaucaaaggauuauaccagauuacuccccuacaugaugcagugaugaauggacauuauaagguggcagaguuacuucuucugaauggagcugauccauuauuuagaaaugaugauggaaaaugugcuuuggaugaggccaaggauuuauguaugaagcgucuccuugagagauauaucccuaaacaucaaaaaugccuuacaucagcucaaaggaguagcauugacccacuagacauagaggauguguaccaacacaagaaaccaaaguucaguucuaaaagucacauuuggcauguuuauaaugaaaauuccaacagacagaagcuggaacauguaaaagucaauaaaggaagcaaagcgaguuuauuuauaaauaaagaagauguauaugaauauuaccaaaaagaucccaaaaacacaaaauuugguaaauccaagcauaaacaaucaacucuugaccagauauacucuacaggacucagaaagggcaaucuccauaacgucaaagaucccaacacaaacguaccaaaagguauaggaagaagaaaaacacaacauaaaaggacccaaguagaugauguagacuguaauccaagaaagauacuagcugucucuccuuccaggagaauaaacagauugguuaccuaucagcagcauauuccagaaacucauaaugaccuuccagaagaauugugugaaccuuccagcuuaacucugucaagccugagaaauggauuagauagcaguacugaggcuuguucaguuuccaaagagaaacacauccagaaccuggauuuaucagauagucaagaaguucaaugcuuggaauuagaaucuguugaccaaacugaagcuguuucuuucccagggcuuuuauuacauaaagaaaucaaguuaccaguuguuacuacagauaagcagccucacacucuccaggaacaacaccauguacuuuauaaaucucaugaaaacaguaacuuggucccaaaagaugagagauuuaacaaaugggaaaauucuuuccuauccuuuguaaaggaaaauucugauaaugaugaugaugaugauugcucuaccucugagaaggcuauaacaucuaaaaagguguuguguucuacagguggcaaaaaacacuauaauuuuaaggagaauuuaacaaauaaaaaagaaauggguuuccaacaguuuuuacuuucugaagaucaucuuucacaggaaaaugaguuaaaagcagucagccuaaccacacuuccagaacaggaagcuguuaauuuuucuuauucagauaaugcaguuauuucugaacauguugcaaauuaugaacaaugcauauuuggaccuucuuuugaucacucaaauggcaauccugagcaaaauucccuggcuuguaugagaacacuuuugacacaugaggcuucaaaguugacuaaucauguggagcuauucaaaaagccacaggauuauauucccagagcaccaacuuuuuuaaugaaucaaacagauacacauauuguggaaaagauggcaaagaauugugacacugagaggaauuacauugacagagaccaaaaaauaauuuauucaaaugagccuuuauccauaguugcucauucucaaguaauagaaacaacuaaaguugaaaaaaggagacaaaaccaucuagaaagugagacuauacacaauauagauucucauuccacugacaauaugaguaaagaauuggccaacaucucaaaacuuagucaaagagaaaagaaggaaauuucucacaaaccaggaaugaaagcagguaggaucaacaagaggaaugccagaggggaaagccagcuucauuuagcugucagaagaggaaaucugccccuagugaaagcccugauagaaucuggagcagaugugaaucuaaaugauaaugcagguuggacaccacuucaugaggcaucuaaugaaggaucuauugauauaauuguagaguuauuaaaagcuggugcuaagguuaauugugaaaauauagauggaauucugcccuuacaugaugcuguugcaaacaaucauuuaaaggcagcugagauucuacuacaaaauggagcaaacccuaaucaaaaagaucaaaaacagaagagugcuuuggaugaagcagaugaugaaaaaaugaaagaauuacuaagaucuuauggugcuauugagacuguuaauagagaugagagugaugcuauagucaaugaaaaaauuccugcuguccggucuaaaagacauaaacaguguuuuugugaugauggcaaaacuauugacucaucuucccuuucacaccaagaaagaucaagagaaagccuuucugugcaucagacccucagugccauucuacaagauauagaagaaaaacaagaauauuuauuagaguuugaaauaagaaacccugaagaugcagaacaauacauugaaaagauguuaaagauaaaaaagauuauggauaaugugcuugccaagcagaaagcagaaagggaugaucuggcuaaaaaauacaggguauccauagagucauuuaagcauggagcccugagagaacaauuggccaacuuggcugcaagacagaagagccuuuuaguuguggcaaaaaaacagaaaaaaauaagccugaaaauucaaaacuguaggaauguuacaucauugccuugucuuaguuuaaggaagcucccacccagaucagaaaucucuagugaaaaagacagccaagagcucacuagucuggaaaauuuagagcauccccaaucagguucacuuucuccuguuucuggaagcaugcaggaaacacaauugucucuggaaacuuggaacuacagccaaaauaccaacauuugucuaaauucagaggcagugagaaggggagaauuuucuggaaaugauaugaauucuaaacaaaauggcagugauuguaccuuggaugguuuuccaaaauccagacauucagauggcacagagaagaauaaauuaccaucccaaccuguugcuuuuauuggucaaacagaauauucacagaaagagaaugaucuuacagaagcuacagacaaagaccaugaauucuauguuucuuccccaguaaucggcaaauuaaauauuucagaaacugcaaguguccuugccgaaaaugcugcccauccaucaaauauuauuugugaucaggaccuuuccaauuaugaucccaaaagaggaaacagaaaaacaaguucccagcaaucaccuacaggggcaucagaaucucuggcacaucaagggauugcugucuuaggcagugauacagugcaucagaugaaaccauaucuuaaaaaaucaguuucuguuguuccaugugcagaugacagucagaucuccucuuccucuggaucugggcaacaagauacaauaaaaaaggcuuuaaacuacaguacagcuccuaaaaagaaauguauucagauaaaagauuugauauuacuaggaagaauuaacccaggaaauaacauucuggaauucaaaacacaggagacuacccacaaagccaguauuuuauugaaugguaaacuuaagguagaaaguggucagauuuauaaaaacccagucaccuggcucaaggaucuucugggaggcaacaguuaugugaccuggaauuaugcuuggaguaagguaacguaucuugggaaggagcuuuuaagguauguuucugaggaugcacccauacuuccagaaccaaacucaguaccucagcaauaucaaccuugucuuccagaaguugcuuguuuagaugacccaguacaggaaccaaacaaaucaauguuugagaaaacaaaauuuggacaaggaacuuccagagagucaaugcaaagcagcccacguuaucuacaaauaaaugaaauacuauuaaucagugaucaagaauuucucccaugccacauaauggaucagcauuggaaguuuuguguggaaugugaggaacuaacacccuaaaaccuugguuucuuaauauuuuauuggauauuuguucaaauuaccaacaaacauuuauauuucaucuuguauaaucuggugggccuauuuuaacauacacuuuaugaguugcuauuuaggauguauguuuacuguucuuaagauguauguaacuguucaacaauuauauaagauuaaugcuuuuuugccauugaaauaaaggcacauuugaacuagaccauauugauuggcucucuggcuuucu

SEQ ID NO: 1231 - RNA, 636 nt, Homo Sapiens
uuuuguuucauguuuggggaguaggaaaaauagaaccugaaaguugaaaaucuccaucuuauaaaugaauaucauugccucuaccuagaaagcuacuacugaccuaucaaaaaccuuguagacaaguuaauacuucugugaugugugcagcucuuuaaacaaucugccugucaugccagagaguacauuuucacuuggcuucuuuaacagacagucuaagaagaaagaauaauaccaaggacuccacagcugcuucugcaugaggcaaggguuuuccaucuguacuguaguauuuggcccuuaaauaacuuuuuacaccccacagugcaugucuauauaacaaggaaggaaagggaguuggaacuacauggggccacaugagaaauggaauugcuucuuuuggcuuaagggcauaggcaaucuaagacgcuucucccugggacauaccauguaguuuuuuauugacuuccagugauuuuaaugcugaaagagccaaagucaaggugaguguucuuaacauauugacaucaauggcccagccaaggagcugccaacaggccuuugagagaacaguuaggacuccuuguuuaccuuuccccacaaagacauuggaucgggguggggugcauauaauau

SEQ ID NO: 1232 - RNA, 453 nt, Homo Sapiens
uuugcauguguuuuaacaaucccccacccuccagagcccuaggucuauauccguaugaaaugcauugaucgguaaccuuaugaguuaguguuaugaaagccauuaaaaaguagaccugguugaguuaauuauuagcacuuugaccccuaaaaaauguuccugguuacagaaaaguccuccauucaggccuuucuuguaagugaagaaaaaggaaugcagcaaagaagaguucuaauuuugugucaggagauaaagagggaggcucaguuaugugaagguauuccucacuugaugguuugaaagucgcuucaauauuuacaugaauuuccuuaaaagaauccuguggggacauuacagaugagccgacgucuauuccuggcagagcacugggcugggggaucucuguguguccagaggcuucacugccugaguagauagugaggggagaugaug

SEQ ID NO: 1233 - RNA, 6956 nt, Homo Sapiens
auccaaggauacaauagcaguuguuuguuaagagaaauuuaaacucaacaccaauacugaguccaguaaaccagaaaauaugcuucuggugauuuggguggaaggccaucuccaguuuaagaagcuuuaugugccacuaucaucauugucuguuauccuugaucuccuuuggugaggggaaggcgggaaagagaggaccucuccgacccuuggauuuuucuuuuaagcagaggcuaauaaaacaaagcgcaaacugacuguccugaggagucugcucacaccgcugccccgcagaucauuccacagaccccuugucccaucccuucuggacagacccaggacugaugaggguucggguucgggaggugugguguggugggggcuuguguggcuguagcggccggcuuuccuaaaccccagagcgggauacucgggaucugagcagaggggaaagucaucuaagaggcugcugcuuuacaaggucugggcacagagcugccccucccuuccucccugaaguuugcaugaagugcacauuaggcuguaauuaggggauuugggaggagaacuuuccuggugacgcuuugcuuuucuucugcucuuggugagaaagugccuccuucuucccaggaucaggaccucugccauccagcgccacaaagagacauucugcacacacacucacacacgcacacacacacacacucucacacucgcccagagacaaacuuaaggugaggagaaagagcgcuagcuucacuugaucuccagcuuccaacuuaagcagaacuugagagcauccgaacuccuggauuucaggacaaggacugcaugaagugcauuggagagaacagaaguuucugcugcuaaaaaccauuaauauauuauuuuuauuuuuauuaugacuuaguauaacuagguaccacaguaaaucgaugaucauaaaacuuuucauuguauguaguacaaaaucagaauugacacauauuuaaaaaucuuccuaugccuucucagagucuggugacuuuuuaaaauaugucgccccuucucugauuccuguaaacaagcagagagcacaucacaacucugaauaagugaauuagguucuggaguagaggcucuccuacaaggaccuccaggaacagacucagagcucuuuaauaaguaucccagggagucaggcuuucuuggaaaaaacaaauuagugugagaagccaguacugugcaauuucaguuuuaaaaauagccgguauugucaaggcugcugugugcaugagagaaauagaagguccuuguuaauuuucgugucagcuuccacauuaaaaccaagaagcuccacugaaauccuugccuggcaaauacugcaaagguuauaagguggauccgcugacugcagagacccuaccuggcacucuaaguuggugcgucagcauuuuagguugaaaugaaugaaaaaucaaucaggaugacugcagugguagcgugcacaacucuaaccuaguuuguucauaauuuucaacuauucaccguagacccaagcaguauguaagauggguagcaggaauuguucaaagcugccgucuucggcucuuaaaggcagcuacaguaacuuucugaacagauuggguuaaauauuuuuacagacccauucuaugaugauaaggcgguaauaaguugugcagugcaacacuccaaaggguuccaaaucucacaagccucuuuguaugugaugcucucgcagugaagaagauucuuugggcuauaaagaugaagagucuacuucuucuggugcugauuucaaucugcugggcugaucaucuuucagacaacuauacucuggaucaugacagagcuauucacauccaagcagaaaauggcccccaucuacuuguggaagcagagcaagccaagguguuuucacacagagguggcaauguuacacugccauguaaauuuuaucgagacccuacagcauuuggcucaggaauccauaaaauccgaauuaaguggaccaagcuaacuucggauuaccucaaggaaguggauguuuuuguuuccaugggauaccacaaaaaaaccuauggaggcuaccaggguagaguguuucugaagggaggcagugauagugaugcuucucuggucaucacagaccucacucuggaagauuaugggagauauaagugugaggugauugaaggauuagaagaugauacuguugugguagcacuggacuuacaagguauguaucuauaagucauguucaacguauaaauggucauuaauaguugcuuuuuuuuucaugaagaguaaugucuagugguuaacacaguaauaaagugaaaaaccaaaguccuugccuggcaucuuauucuuuuguauucuacagucugccuaugauuccagcuuucauguuugaaaugcauacacaaugcuuaugugcaaaauugaagcuauuuguaacuaggagaaacgugcaguggaacugaauuaacaguuuucagauacugccuuauguuauucaaaaucaucuaaauuccauuauaugguuauugagaaauucagacuguguacuuuuuuuauuuuguuucuaaaauuaucucaguuucaaaauaauggcauguuuuguaaaggacaucugcuaacuaaaauauauguaauuguauucuguaaaagugugguauucccuuacuuuccacgacuggggcgcuacaaucucaauuuucacgaggcgcagcaggcgugucuggaccaggaugcugugaucgccuccuucgaccagcuguacgacgccuggcggggcgggcuggacuggugcaaugccggcuggcucagugauggcucugugcaauaucccaucacaaagcccagagagcccuguggggggcagaacacagugcccggagucaggaacuacggauuuugggauaaagauaaaagcagauaugauguuuucuguuuuacauccaauuucaauggccguuuuuacuaucugauccaccccaccaaacugaccuaugaugaagcggugcaagcuugucucaaugauggugcucagauugcaaaagugggccagauauuugcugccuggaaaauucucggauaugaccgcugugaugcgggcugguuggcggauggcagcguccgcuaccccaucucuaggccaagaaggcgcugcaguccuacugaggcugcagugcgcuucguggguuucccagauaaaaagcauaagcuguauggugucuacugcuucagagcauacaacugaaugugcccuuagagcgcaucaguuuuaaagucauuaagaacaugugaaagguguuuuuuuuuuccaauaugaacucaugcaaguuaccaaaacugugauaacccuuuuuuacuuacuguaaagagucauuuucauaaagaucaauucauugauuuguuuuuuguaaagcuaucauucaauauauauuauaaauuaauauaaauuuaagggaagcucuauguaaggagacuuagagccaaacuguuuaagcuguaucaucccaacaaaguauccuuucaugaacggggcaugcaauagcuuaagaauugcuaggauuaaauuaaggaaaguaaagcuacucagagcagcagguuccacaagcacaaacuuuacacauuuguacaauuuugaaaugcacuacaauaaacaaauuagagcaacacauuugaaauacaggcuucuuuacauaaacugagagguuauacaaaacucaguuucacaagggaacaaucuauaccuuucuaaaaguuaauauuucaagucucuaauaggcagaauauuuuacucuuuaaaauccugccuuucugaccaaaaaaaaaaaaaaaaauucauauggauuccaauccauaguaacaagcacaguuaaaacuccucaauaaucccauuuauaugaagcaugacacauaaauaagcagauaauauuuaaccaaugaaaaagacuucuaccuucuuauaauuaaaauuacacaugucuaagaggaauuguuuuaucuuuugaguagcuuuaccgaguuguauuuaaauucuaagggccauuugcuaagcagcauuuagcaucuacucagggcaguuauauagauaaacugcuggacagaaaaauuguaaaauuuagcagcuugauuuucuguuagccuaugaaauguuauuguccuauaaaaauaacuuuaaacugauuuaauauuucauauuuacauuauaugaaaaucaauuacauuauaaaaggaaucccuaaugcagaaacaaagaugcaacuuucaaaauucuuauuauuccuauuuguauauacacgagagaacccaaccagugccuguguuuggggggaaaagucaacaguguaguucuaaaccuuaucccaaacagaaaaugugguuaaugaugucacuuuccuugcuggucaucauuaggcuuaaauuaaaugcugaagcugucaucaaagaguuuacacuaaaaucuucagggcuuuaaauaaaagguuaaguccagcuuccaaacacaauuuuccacauuagcagcuccaaucuucuuaaauaaagcucuguuuuccuauauuuuuaugacugcugagaccccacagggaccaauauuuguauucaaauuacauuucaugguuucccauuguuucacaaugaguucuaauaaaugggauuuacuauaauaauccaaguaugacauagccgguaugcuuucaugaauguuuuuauguagauuuuccucccaugaacaugaguaaauaaaucuguuuccugaauggauugugguugcauuuaaagcucuguaauaauucuaauaaauuuacucuauagaguucuguguguggaagguauagaacaauuggaaguccaugaaaccauaacuauaaucauauauuauucagacaaaauauuguaauaaaaguagguccuuucuuucaucaaaaacauaucugaaaauuuucagaugcuuuaauauuaaaagaugacaauguuauguaugcacauuuuuaaguuagguuggauaugcaaacuguacaaaacuauaaauccaaagaguuuguaaaguuuaaacucaaacacuggugguauaaauagaacuugcacuucuaaauuaaggaagauaccuaaauggucuaggaugagaugauauauuauuuaaagaggggacuaucucccaaauaacaacuuuaacaccucaaauaugggggcuagcucauugaaagaaguccauacuugaacuauuauuauguauguuccgauaauuuuguugaaaauacaagugggaacaaauuucuauugaagcaaacaucuaauuuucaguuauguccagaacucuacuuuauaauguuaaauguaguaguauuucuuaacuuuuaaauacuuacuacuauaggaauuggugcugaucaaaaucucuggagugacuguuagcugauuaaaaucuauaccacuuacacaucauuuuuccauucguguaaaaaacaaaaaaucuuaacacagugaauacugcugagcagaauuuuuucuucucauuuugcucaaaggaccagaauuuccaugcccuuuauacucauacuugaaugagucuuuuuaauguucucauuuugcuguuuuuccaccaaaugucuauuuuccuacuucauuccccaagaugucucacugagcaggucugaaaaagaaagguuauucuaauacaauuccuaacagaaaguugguacaacacuggcuaauucagaaaucgcuccucagacuuagauuccaagaguaucaaagagauuagaugggaggcugggccaggaacccuuguuuuaauguauuuguccauaauuaacacuggugaccauauaaggaacaaaguauaucugcacauuucacugagacaucuacauuggaaaacccaaacaaaaagaagcaauucaaauaaaaagacaacauaagaacgaaaauaaguuggucacauuaacacuggaagccaucuuuaagugagugcugucauauugugucacaguaauuuuuagccaaauauggcguuuguaaauuuaaacuuucucucauggaaagggggcugguaccugucaaaguguuauuuuaugcaacaauauagucacuuuuuauuuuggcaauuagaaguagacucaaaggagauuacaauuugguugcuggcagccauucuggguuucuugauuuuaguacuccaaagaauaugguggucucauggaguagcugaccacuaaggaggggaggauuaaaagggaaucacuuaucaguuuuuagcauaggaugcauuaagaaauaucaacggauaacugacaucguuuuguuaagaaguuaacuguaucguagcucacuacugccagagcggcaauggauguacaacgaaagagaugaaaaauacaaaaguuauuaagccaccugauuaaaagaaaaccaauauuuaaaggcauuuaauagauaucaaguauaacuuugaggagaagaaucaaucuguauuaccaaaaaaaaaauguuuugauuuucuguaagauacaaugaacugguacauuaaaagucaauuuuguguuacugcaguaucuuuuaauucuucugaguuguagaaucuuagcuauuuuucuuugugucaaacucugucaauacauuauuuccaagaaaggcauuuaauucauucuuguucugauacauuugacuucaaauuguaaauacguacaauuuucauuuccuaguacucuugcaaagucaaaaaaaaaaaaagagcauuuauauggugucgcuaaaucaacuauaguauuaucccaaaauauauugacuuuuuucucuuuguauaugacucaaagcauaauuaauuuugcccaccaguucagcaaucccagaaaucuauuguguuguugauuagauuaacacauuuuaaaugcuuuauaacuuaaucaugagugcugaauuaaaaaaagguuuuucuuuucaua

SEQ ID NO: 1234 - RNA, 597 nt, Homo Sapiens
ucacuuuuaaaacaaugagguuuuauuauuuccaauuacuuacagcaaguaacugcaucuaacuaccaucaaagcauuacuagaaauguuagaaaucuacuagaaauaacuagaaaucugccaagcuagauauauagaguacauguuaguauaaucaaguuuuauuuuguuggaagggaccuguauuauucaggauucuuucuguuucaaauaauuuuuaaaaacugaacucaaacuggcuuaaaaaugaaagggaaugucuugacacacagaacuuaaaaauccagagguuaaucuggcuucagacauuauuagauguaugggcuaaaaaaagagccaggacucagucucccucucuccacugcuuggcuauaguuuccucuguauuggugucauucucaggcaagcccuacccgacuugcuagcaagauaguugccagaaguucugggccuaccucuuacccuuucagcaaccuguaaaggaaacgauuucuuuuucccaauaguuuccuuaaaagucuuaggacugcuucaaauuuuccgagcguggaccaugugcccuuucuuggccaacgagauaaaagucacugaaugucu

SEQ ID NO: 1235 - RNA, 12529 nt, Homo Sapiens
agugacgcuccggagccgucgccagggugguaauaccuggugcagagcuugagucuggccagcgggucaggcucuugcuagaucagcaccggagguggaagacugguacauuuuacauacuuugggaaaaaaaaacguugcugaaguuacuagaaaagagacaguucuucugcugacaacucuucaggaaauaauuuucuaccuccuuaggauucgaagaccaguucauucuuagugucuucugaaauaaaauuagaauggauugggaugaugaauauucucauaauucuuuugaccuacauuguuuguuaaacucauuuccuggagacuuggaguuugagcagaucuucagugacauugaugaaaagauugaacaaaaugcugcaagcauaaaacauugcauuaaagagauacaguccgaaauuaacaaacaauguccaggugugcagcugcaaacaacaacugacugcuuugaauggcuaacuaacuauaauuacaguacaucugaaucaucuuucauuucucauggagacuugauaaaauuuuucaaaacacugcaagauuuguugaagaaugaacaaaaucaagaagaaaugacauuggauuuacuuugggaccucuccugccacagcagcguuucauucccaucaacccuaaguggaacaucuuuccauuuccucucuaggacgucucuucauucuguugaagauaauuccucuauggaugucaagucuaugugggaugauauaagacugcaucuucgacgcuucuuagugagcaaauuacaaagccauaaugaaauaaacaauucacagcaaaaaauuuuauugaaaaagcagugcuuacaacaacucuuguuucuuuauccagaaucagaaguuauaaucaaauaccaaaacauacagaauaaacuguuggcuaaucuucuguggaacugcuuuccuucuuacaacagagauucaaauuuagauguaauagcucauggauaucaaaguacaaugcuuaaguuauacucaguaauaaaagaggauuuuaacacacuaugugaaauuuuagcuccaucuucaauggugaaauucauuaaagaaacuuaccuggauacuguuacagaagaaauggcaaaauuucuugaaaauuuuugugagcugcaguucagagaaaaugcuguucgugugguuaaaacaagcaagagcuccagcaagcauagaggagcagugcaugcuuuggguuagugacauuuaaaauuuuuguuugguuuaacuuaagucuuuuaauauguuuaauuuucuaagauguuuucuauuugguuaaaucucacugcaaacaugaaaauuagaaaaugaauguaaugaaauuuugcaguauacauuucucaugcauuuuuuucuauaauuguaguuauaaaaguauuuucuuucuuauuaaauuguuaaagauauuggaaauauaagccaaaaauacuuuaaauaagaguuuaauuucucuugauugcauaugacaaacaguauuugugaaacuguguguauacacacauauauauaaaugaguauauaugcuuauacacauauaagcuccuuuaucuguuuauuaaauauacgcauauauauaagcacauauacucaguuauauauauguacauuuaguuauauacauaacagaaaaguaugauuuuuaauccauuguaucuuccaaagcuaaagcauuauuagguaaaaagaauuuuugaaaauuuguugaaauuugcaguaaaauuggauauuuaaaaguuguaauauuuuagucagucaauucuaauaaugagcaacuaugaaauacuauaauuauaaaauucuguauuguaguugauuaggaagguauaacauuuuacuauagcuauuuuuaaaguuucucuacuauuuuuucuauaaggauguauacaaauaaaagaugauuugaaaauuucuauuuuauucauaagauaaaggaaaaaaggaaagaaguuauugugauauaauaaacuuuucuuauugugguuguacuuuccuaccaguggagaaaaaucaggguaaaaauaggauuauuucuaaaauuaucauuaguuaugcuuuuauauaaaaucugagguguauuucugaauaaguucauaaacuauauggcuuaaguauuugaaaauuauuauuuggugaauuauggaucuuugaauuuaugaucaucuuuuuaaaauuccuauagcucacuauacuugugcguaucuucauuaauaaaauuucaguugaccaaauuaaugugauuacuacugaaugcccacagaaaggaagaaacuucucucucccuuuagacaaagucgaauucuuaucgcagcucauaaaauccuuuaugaaacuggaaaaagguguucaagaauuguuugacgaaauacuuuuaucacucaagauaaccagggauacuucaggaauuuuggagaaauccgauagagagguuguaauggaaaaaccuagagcaaacgaaaccaauauuccuuccgagcaaucacuaccaggaaaagaggcuaccuuacuagauuuuggcuggagaagugcauuuaaagaagugucucuucccauggcgcacugcguaguaacugcaauugaagguuuuuccacaaaaauucuccaacaggaacagaaugaaaggucuucagcugugagcuaugcuaugaaccuuguaaauguccagcaaguuuggcaagacagccauauguuuccugaggaggaacaaccaaagaaaauuggaaaauuuuguucugacaucauggaaaaacuugacacaaugcuuccacuggcucuggcaugcagagaugauucuuuucaggaaauuagagcaaacuugguggaggccuguuguaaaguggcaacagcuguccugcagagacugcaagagagagccaaggagguuccuuccaaagcaccccugaaaaacuugcacacauaccucuccacagcgguguaugucuuccagcauuucaagcgauaugauaauuugaugaaggaaaugacuaaaaaacccauauuccuggugcuuguccaacgauaucaggaauucaucaacacucuacaguuucagguuacgaacuacugcgucagaguuugugcuacaagcauuuuacaggaugcugagagccaccacugggaugacuacaaagcuuuuuaugagggggaaagauguuccuucucgauccagauguggcauuauuucugcuggucucuucauuacgaucucuggaccauucugccuccuaaguuagcccaggagauucuaguggaagugcuggagaaaucuuugagucuacuggccuccagauacgcucgggcccaccccagccguaaaagaacuccacaguuaagacuugaugucacaacaauuuugauaugcacugagaacauguuauggucaguuuguacaucuguacagaaacuuuugaauccucaucagcauacagaugauaaaauuuuuaaaauucacacucauuguaauaaucuguuuacaacauuagucauuuugacuucaccauuaacagaauuauauaagacuuuucagcauggccuggaugagucugcuucagauuccuuaaaaucauuuuuuaagcaaccauuauauuggguuucuugcauaucacauuucuacccuucuuuacucaggacuccaucagcuggaggacugaaagccgagggucaguugaaacugcucuuaucccagccacguuguaacuggaacuugcuucuggaaacccuacugcaucaugauggacuuuuacugagaaucuugcugaagagcucaaaacguaccuuucaagaacaaguuuccgacacagaaaauaaccugaaccaaggacccagcuugauggaagccaucuuuaaaauauuguaccauugcaguuuuucuccacaaacauuugcaaacguuuuugugagcuacauggaagaagagcaauuaugggacuuuuuauauaacaucccagguaugagacauuuacuguuuguaaaagaaauguucuauagauacuuauauguaccuuuaaagauguuuagaaguuguauugauacugguuuugcugaaucuguuguuggugaaaguuuaccuuacauuuuuucaguauaaagccuucuguugggaaucauuaauuauugguuccuguaaaauuucauauacuuugggacaagaugcaagggagguggaagggaaaagauuuucuuuuuuuauuaauuagggaauguucuaucauaaaaauuuauuuuaauauuuaucacagauuauguuuugcuauugagcauauaagauauuaguaagaugugaaaaguauuuugugauucuugggugcauuuauucagcaaauuaauggacaauacuauuggucgauuuucuucagauguauaaggcauuuauuauuaugaccauagugugucucucuacaaggcaagcauauccugugauuccuuuggagagaauauauuuuucccaucuguauuguucuucuuccuucagcuagagagaauaauaaaggcagugcagguuguauauuugaacaggaaguuuugauggguugccccacccucuggcaggcguaaaaauucucacauugucuuauccuuaauauucugccuuuaaauuuucauauuuaauaucuugugaaaacaaaggaugaaaacuuagacaaugauuuuuauuauuauccugcuauucaaauagugauuuuuaucauuuacauuuaguuuucaaccuguaagcuuucuuuuauccugcuuuggaaccugaauuuucauaaaauauuuccuaggcuccauauaaaagaucuaacuaguucauaaucaugguuucacuccucccagacuuuuugacuauccuccagauauuacuugaauaucauucuagcuguuuuacagucauuauguuucauuuucucuuggccauuaucccuauaaacuagcaauagauaacuuuauguuaugauuuccaaaguccaaaucugucauuuaaaguuucuguaauaaugaucucuuuuuaaaauguuaucuccuaguugccaugcauucccuuacugcuucuugcuucccaaaggaagggcauauuccuagguaaaaaggcugaauuagaagcuuguuguguuucugauguagucuuuauugaauugaaagaaaaacgaacuugaaaguucugccacccucugcugauuuuaguuguuucuggggaaguaagagcuggauuuucucacaagauuauaaagaaucagugacccucaugcuucaaucacuauuuaucuuucaacuauuagguucuugaaccaucuuugacacucagcacaaaacuauacuuaaaauaaccuagaagauauaaauggauuucaggugcugcuaggcaaaauaaaacuguuucuugcuccuaauuugacaucucuccauguauguagugagcaaacccuccccuacauggucagacaagucucuggaaacagacguuauacauauucacagagccugaauuauaugugaaagcucaaaggggcagaacuucaaaugggugaaacucccuucuccuuuauacaaguuguugcuccauaaacauuaaauauucucuggaaccugauaccugcagugguuaugagggucugaaguuuucucuuuucucucccauuuaagucuuugaaaauaucuuuuuuuuuuucuguuagcaaucaugguuauuuuaaaaacccuaauaagauaauacaagguacuaauucauaacgaaauuaagccuuuuacuaugacuuuuguuuaauuuggaaacauaacauuguuacaaguaauacagcugagacauguaaucauaaucccgcaauauuuacauuuuauuacuaauagaucuaugcuucaguaucuauaauuaaccuacccagauuaacuaaaguacauuauuuuaaaacuucacugcuguaguuuccuccugcuaaaucacugucuaugauuucugcacaguuuacccauaaaacaucacagucuuaucauuuuaggguaaaaggacaaagaugaagugguaucuucaucuuauuguugaguaaacaaaaagcagaaauauuaagagaguugccuaagacuguccaccaauuaaguuggacaagacuuagcacaagaaaccagaucuccucucuccuaaggcagcaguccccaacauuuuuggcaccagggaccaguuuuguggaagacaguuuuuccaccaggagggggauggaugaaaccguuccaccucagaucaucagguauugguuagauucucauaaggagcaaacaaccaagaucccuugcaugugcaguucacaauaggauuugugcuccuaugagaaucuaacaugcuucugauuugacaggaggggaagcucaagcaguaaugcucacccaccugcugcucaccuccugcugugcggcccaguuccuaacaggucacgaaccuguacuggucugcagucuagggguuggggacccuguccuaggccauguuauuucucauuuuuuucuauuagacuaaauuuuuugagacacuacuuuuaugaacauacgaauucaguaaugaauuauacaaucugauuuuauacuuagaauucuaucuaacacauaacucuuuagacuggacauaagcuagggagggaugacaagaaggaaaauacccacuuaagauuacuacaaaagcuauaaguacaacaaauaauuaagucagugaccuaauguggguguuucuaaggccaaugcacucuguaagaaauaaauuugcuaacaaucauuggacaccuauguuuucaaaguagaucaagcauuauucaguuagacaaaugaaaauaucaaagcauacauuaccucagcugguuuuuaagacaaugucagaacaggcuuguaaaugaggcaaauacugucaaaaaugcccaucuaauaugauaguaauauacucaaaaaguauuguuuacuuggcuccucgauaauggcauugggcuuacuuuuguuuucugaaucaguuuucuuaacuuucucccaaccuuugggaaaaaaguuuuccauaaccuagcaaaauuaaggguugagauucaaaguuuccacuuugguuuucuacuccuccucagccucauaaagaccuuuaagaaguguugucuagagagcauauauaugcuauauugucugccuguugccaaaauuaauuuacagugccuuaccuuccuaucagacacagugauugucucuauuaccuacauaaauaccugcgccauaguauagguagauuuuaaauguaagcuuucacauauugaaaggcugucuuuguucuauguuguaacuaaucauguauucugagccuuuugucaccaguuuguuugcaauccaccuuaaaaauguuuuaaaauauauuuauugauugaauacaauaaaauucacucauuucaagugaagaguucaguaaguuugaccaauguauaaaucugugugacaaccacaacgauaaagauauggaacauuuuaugucaucuccaaagguucuuucauucccccuuugccguccauucuccuuucaacucucagccccaggaagacacugaccugcuuuuugucgugauaguuuacuuuugauauucuagaauuucauauaaauagaaaucuauauauucuuuugugucuagcuucuuuugcucagcuuaauguuuuugauaauuuuauauuaugcuuuaucauuaguuuauuucugcucauugcugagcaguauuucacugaguaguacuuuuuuuauccacuuaccaguuggguggacauuuugauuauuucuaguuuuuggcuacgaugaauaaagcugcuaugaauacuaguguauaagucuuugugggacuacagucaucccucaguauaugugaggaauucauuccaggaaccauuccccuucuuaaaaaauccauauacucggccaagcaugguggcucacgccuguaaucccagcacuuugggaggccaaagugggagaucaucugcggucgagaguuugagaccagcuugaccaacauggagaaaccucguuucuacuaaaaauacaaaauuagcugggcaugguggcaugugccugcaaucccagcuacucaggaggcugaggcaggagaaucacuugaacccgggagguggagguugcagugagccaagacgccauugcaccccagccugggcaaugagugaaacuucaucucucucaacgugcguggaguacgagcuagaggucauccgaugcuugagacuggcacugaccgaugccaucaaggacacuguacagcagauaguaucuguaaugaguucuaggagaaacugugagacaaaccuaaacaagcacauuguuccugauuguuugcuugagagcaugccaaaggaauggaauuauaguccaaaagaaacuaacaggaaagaaucaugcaaaagcuucacaaggcuuacugcucaggcaguaucuauuguaaucagcaaguuaccuacggugauugcauguuugccucccccaguuaaauacuucuuuuuucugucugagagaaaaaugucaaaaaaauuuguugaauugaagaaagcuggccugcuugucuggaacuugauuguaauuauaugucggauauuugaggacggaaacacuguggaacuuuuaacaggugccucucuugacagauggaguaaagaaaaauuggguuuaauuuguauguguuugaaaagcaucaugggagaccagacaaguauccauaaucaaaugauccaaaaggucauacagagcauugagcagcagaagcccaacuggauugaacgucaauuguugaaagcaaggaaacugagcacugaaugugcauuuaugacaauagagaaaagcacggccuuacaagaaggagauguugcucuugaacugacugagcagaaaauaaacacgaugguccuggaucucugccacaaaccagguggcagggaguaccugaggcaaauuuaucacaucaugcagcucaaugaggaauauuuaaaagaacagcuguuuucuaugaauaguucagaggaaaagccauuacccauccgaccuuuaaagacgaccuugaggaguauagaagaucagccuucugccuuuaacccuuuccauguguauaaggcguuuagugaaaacaugcuagaucagguauucagccaucacaaaauggaacuggaauugggcaaaguugcugccaaauuaucugagacuggauaagaugaccuucagugugcugcucaaaaacaggugggaaaugaagaaggaugaaacacuagaagaggaagaaaaagcaauacuggagcacuuaaaacaaauuugcaccccacagaacucuucugccucagauaacauagaggaacaguaaucugcagaaaacagcaacagcuuuauuuuaggaaacaaucccauguaauggaguaggauuuuuuaccauagucagaaugaaccucauaugugcugugaagcaugaaaccaaugacugaguaaucucuguacugaaaaggaauacagcacauaaaggauaaggugcuacauauuuuuuuauuuuaaaaauaauuucaaauguuuuucuuuccccaaucuuucucuuuauaugauauaacugcugccaucucguguucccuuugaauuauuuuuuucuccuuucagucuugaaguaucuaugacaacaggaagaaauguucagaaauuuuuuaaaggauuuuuuaaauacaacauuuggauguuaaguugaguggagucacauagccccaggaggucaucugaaauuuuuaauuuaauuuuguuguagcuguagcccaagucccaauuuuaauugccuuuacuauccacaauugugucaacuuuccucauucaauuuaucuaauuauagucaaaaaaaagcauucuccugaacuauaacuuuagucacaccucugcuuguagugguuuucagucuuccuccuaaaccagaaucaaauuucuacucauacauauucagguccuauaccaaauggcuccauguucagacaauugcuugccauccucuugguucaagucacaugcuugccauguuuucccaaucagaauccaucuuucuuccaaaauuaggcucaaaacuaauuccagcaaucuuuaccccaaagcucauuagcucauauaauguguuacuuuaaaauuuuuucauuguauugauacacacacacaaaauaagaaaacagaacaugcucuaguacccucucugccaaggacaauuauagauauuuauuauuuccuuccuaucacugccugauauuagauuauaaagacauugaagauauuaugauauaauaugaagucucccuuuauaacucccuguaugccuacuacaguguuauuucaucaaguggacaguuaacgaacacaauugauuaaauagcugccaaugaaagaaaaagacaacaaagagaauugcaugguugggcagucuaagaacgucugggagaaaccauauauauauauauauauauauauauauauauauauauauauauauaauuuuuuuuuuuuuuuuuuuuuuuuuuuuuuuuuucauuuuagaaacagggucuugcucuguugccuggaauguagugcaguggcaugaucauaguucaauguaaccucaaacucauaggcucaagcaauacucccaccucagccuccugaguagcuagaacuacaggugcaugccaccacaccugguuaauuuuuuuuaauuuuuuuguaaagaugaggucucacuauguugcccaggcuggacuugaacuccuugucucaagugauucucccaccuagcuagaacuacaguugugugccaccacaccugguuaauuuuuaaaauguuuuuguagagauggggucucacuauguugcccaggcuggacuugaacucccuaccucaagugaucuuccccucucugucucucaaagcccuggaacuauaggcauaagccaccacaccaggcccagaagccuuacaucaugggcuauuuuagaccauaugacaucaaacuucauguuuucugauguucucagauauauaauaaauuguccauacucccacauucugugauuuuuauaaaauauguguaggcuacaugauuuccaaaggaaaguacucaugcauuuuucaaagaguaaaagcuuggggugcagaggaggccacauuaggaaaucucuuacauuuuuucuuuaaauaaaaauacauaaauggccauguagacagcugccugccaaauaacacauuuuauuuuuaaaaaauguacuuuaguuggccaguauaaucauaaaccaaguguuuuuaagauuugguugaaguaauuucuaaaaauucuaugaagaccauuuagaaaaugguaggaaaauuuuaugagaacuggacauuccaucuaaucugaucuuuaaacagguuacuauaacaaucaacauaaggcaacaguugacuuuauuccuucagcuaagugguggucuguguacuaaaucugcauaacugugcuucauuagacaagaugcaaaaauggaaaguuaaaaauaaauuaauccaauaaacuagauacaacaucuuauaaaauuacaggauuucacauuuggauugucuucuaauauaucuaaacgucaucuuuuaaagcuauuauuauugaauucguauauuccuguauuaauccugggaaguaauuuugcuccuccagaaaaaaucuuuucuguggcucccuuuugaaagaaaggaaguauaguaaggggaaaaugggaugaguuuaaaggaagauaaaaguaggagagaaagaggccuugcaguugaauucuauucugugcuuguucagugaaauuauuauagccauaagugcaauaaaguuuauaauugagaguauuaggugacaagucauugauuuaucagauuauuuugacuuuauacucaauauguuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuacuuuuuuguauuuuuaguagagacgggguuucaccuuguuagccaggauggucucgaucuccugaccucaugauccacccgccucggccucccaaagugcugggauuacaggcgugagccaccgcgcccggccauguuuuuuuaaguauaauaagaagugguauuucaaagcaguuuuuguuucucacauuugugugaguuaacaacaggaaugaagccuaacaguuuauaucuccccauaugcuuauuacaaaaauauuaucuuccuauaaaguaugaucuuccuucuguguucugcuuaauuguauuuuuauguaauuauauagagauaucuauuuuauuauugguuuagcaguuacuaugugaaaacaguaugaaauaauuuuuaaauaaauuauaaagaauauugucuauuuca

SEQ ID NO: 1236 - RNA, 636 nt, Homo Sapiens
cccggugcuggguaaauuagagaaaaugaggaacaaaaccacaccuggaaucugaaacuaaaauuaacuuuuuccagcaauguccuauuguguccggaauugguggguucuuggucucacugacuucaagaaugaagccgcggacccucgcgcucaaaauacucuuauuugagccuaagaagagaacuaagaggagaaaggaaugugcagcugugagggucuuaaaagcaaaugaaucuaaggucuguuuccuagugcuaccuuuagggucucuuacccuuggaacucuacacagcugucagaaagagauaaaugaauucuuagaguuugggugcacagaauauugucuuauggaacuucaaaaaucguuagauccaucuucauaaaaagaacucuugcagucaaauaaccuguuuccaggaaaggaauggccauggcauauagaccaaccucgacuugcguaugaaacuacacuaaugggcaucaaguuuauuugaauucgagauauaaacugaacgucugccagagaagaauugauuugauauuuuuauauaaucuguauuuuaguaaacuaaagucuauguauguaaucugauauauauguaauaaauaaauaugcauaauaaauagcaggcc

SEQ ID NO: 1237 - RNA, 5684 nt, Homo Sapiens
agggggcggggcugggggcucggcccgccuugcccugaggcgcugggugccuuccaguuggcugcgaccagcggugacuuacaaguuggcugcugucgccugcgcaucggcgggccgggaggcugagcaguacuguugagagcggugugaggugcuugguagcgcgccguagcugcuuccacguccuugcuucaccucagguaaagagagaaguaauggaaggccugucugauguugcuucuuuugcaacuaaacuuaaaaacacucucauccaguaccauagcauugaagaagauaaguggcgaguugcuaagaaaacgaaagauguaacuguuuggagaaaacccucagaagaauuuaauggauaucuguaaguaacuuuuuauagacuuacacagcucuuaagacauuucaaaacuuauauccauugucacuaaguagucauugcuaguaagauuuagcuuuuuaagaguucuuuaacuuuagucuuaaagggauaugugaucaaaagagcuacaaagcccaagguguuauagaugaccuugucuauaguauaauagaccauauacgcccagggccuugucguuuggauugggacagcuugaugacuucuuuggauauucuggagaacuuugaagagaauugcugugugaugcguuacacuacugcuggucagcuuuggaauauaauuuccccaagagaauuuguugauuucuccuauacugugggcuauaaagaagggcuuuuaucuugugguaauaaucucaacauguuaugcuuuuuuucaguaugguuuaaauauuuguguuuucuuggcuggaugucucuuuccuugugagauauauuuucaacucugacucuguaaucacuaacauuuuuugcaagugcuaaacucuagggaguaaaauagcaauaucaaaagaguuuugaaacccuucugauaaguuuuuguucccaguuacacaguauccucuaggucagagguagcaaauguggaucacaugacugccucuaagaaaggguucuaguaaauggauuuucuucuaagccacucucagaaaacaguuucuuggucauacacagagaaguacuagauuuggugugucuuagaauauucuuccuuccuugagcuguguuguauuuuucuuuucaagauuaaaaauacugccauuggaaggcuccuguuuucuaaaacguaccuauagguaaauuaauauuauuuuguauauaguguauacuuaaguuagcaguuguaaguaaacaucuacuuguuuauucuuaacuagccaguaccaaacuauaauaugguagucgcuguggggaauaguuacgguaccauggauuugauuuuuggcaccucaaggccuggauacuacaaccaagauuuguagcuuccaaggaguacuaagaugauaugaugucauguauucugaaaggauuaaaaguuuccccauuaccuaucugccaaccucuugucagaauucuccuugguaagucucuuuuucacucugccauggucacuuugggauuuaauuuucaucuauauggauaauaauaaauauuuaaauaagaauucugguaauauuuuaaaaugagaguuuuaugucagugaauaagucuugacugggaugaaaagagaccagaauuuguucgaggauauaaccaucccugugguugguuuuguguuccacuuaaagacaacccaaaccagagucuuuugacaggauauauucagacagaucugcgugggaugauuccucagucugcgguagauacagccauggcaagcacuuuaaccaacuucuauggugauuuacgaaaagcuuuaugagaggcaaaauacauucaaacuuguaguacuacagaucaacucucucagcuacauggccuguaaaaaucauugauuccacuuuucugcauagccgguagaaaaauuugaaauguuuuugguucacuaguacaauguuugguuuuauuccuaaaguaaauagcuaucuaagagagggcauuuucacuuuuuuuuuuuuaaauuuugagacaggcucucacucuguugcccaugcuggagggcagugguaugaucacagcucacugcagcuuugaucugaccgcucaagggguuauucuaccucagccuccugaauagcugggaauacaggugcacgccacuaugcauggcuaauuuuuguuuaauuuuuuguagagauguggucacacuguguugcccaggcuggucuugaacuccuggccucaagucauuccccaccuuagccucccaaaguguugggauuauaagcgugagccaccaugccuggccccaauuuaaaauguggaauucaguugguguccaagacuuaucuugagacucuuaaaagcaucagucuguaacuagaacaaauacagucuuagauuuacccaagugccuagauaucauuuuauaaugauuagaauugaguauuguggguccccuaauucugugggugccuuaagugagaauuucuaaaugauuuucacauucuaaaugacuuuggguuuugaacucuccaucuaguuuacuucuaaaaugggaacuugaggcaauucagguauccaggcaaaucuuuguauauauuuuuuuguguacaugcacacaucucgaaauccauuuccguguuuaauguuaguuguuuauguguuaguauuccugugucuacuguuuuguuguuguuaauauggguaaagugagcccugaaauacaugcuaaacaagacaugaaaugcagaaagguacauaguguuucaagugcaugguaguuugaucuguguuuuacuuuauuguguuuucuugaguguaaagaaagaauaaaucaaaguucuucauacccauuuugacaaaguggaacaguggagcuguuuuuugcuuuuguuuuuauuuauuuuuugccacuggugaugauagauuucaaaaaacaaaagguggcagcagcacaauguucauggugaauuaucucauaguaucuagauugaucaagaucugacagaaggaaugcacaaaggauucuauauucuuaaugauuuauuaauuaccaggauccuuuucuaaauugaauguacuuuugaauuacuagguuucuucuuuuuuuuuguucugcaauagugaaagaaaacucaguaguuuaguuucaguuucucauggaaauugguaaauguuaguuuugacuucaucuauuuuuuauuuguuuuuauuagcguagaguaggaagucucauauucuacuguucuaucuaggauggugaaauuccaaaggugccuaacuugaguaagggauuugugacaagauaguacacauuacuauaagggcuauuauuuccugaacuggaugucccuaaaagcaaauaaacugcccacuaucucuacucuagugcucucuuuguccuuaucaacauauaccuccaauaaguaauuacauaauucaccguuaaacauggacccacucuagguaaaauuacccucauggaaacauuuucacugugagaaugaugaauuuaaaaauuauguuugaaucaccuaaaauguaugugcagcuucuagauggccccuuagaucugcugggcucuagcuguguacuuuaaaaaaacaaaaacagcuuuauugauauauaauuuacauauuauguaauuuacccacuuuuaaguaucuaauucagugauguuuuaauacauauguagaacuaugcagccaucagcacaaucuggauuuagaacguuuccaucauuccaaaagauuccuuuugucuuuuuugcagacucauaccuaacacaaaucuaaaguuuaucacuguugccaggauaauuacagcagguuauguuugguuucauuuuuaagaguggagguguucaugauucuaagcucaggaaucuugugaucauguauuaaauauguuaucucauacuauaaugauaaaaaagcuuaaugauguggguugggauggauauuaacauaaauaauugaguccgcugcuucuauagcaaugcuguaggauagaacaauaauguaagugauauauguaauuaaaaaauucuagaagccacauuaaaaaauaaaaauaaacagcugaaguuaauuuuaauauuuuauuuaacucaauacauccaaaauguuaucauuuuaacauguaauugauguaaagauuuauucugauaguuuguacuauuucuuguacuaauuuuuugaaaucugguaugcauuuuacaaauuugggcaagccacauuuuaagugcucauuagccacaugaggccaguggauacuguauugaauagcacaguccuauagcauauuuauuaauuugucuuguaguaagaugaaauagacaauaauacggaauaauaucuuaaauggaaaucuuuguuagucucuagagccuucauugcuugauaaauaggacaucuaaacuuuagauauaaaucaguugucaaugagauaaaauuauugccagcaaauauuuuccuucaaagauaaguaacuuuugauauggcaguuggugaaaugaaagaauauaaucugccuucuuguuaaaugguugacuauucuguagcuuguagguaguacguauuagaaacuuguguaugugggaaauauuuggcauaauacuguuuucaguauauaguagcuauuuuuuaaggaaauuaguuucauacaagaaaaagauuauuauaaaagugauacuuuugcaugaaauauuaguuuguguugauaacucuuaguuaacccuuaaaguuuaaaacaguacucaaaaaaaaauaaugagaaucuaguauucuguaguuaacuaaucuauaagauaaauugcuaaaguacuagggagcuuguaaaucuuaaaaaucuuuuuauuucaguguucauucagguuggauauauuugaaauuguagauuucuaucuguacaacaucuccuaguuaauagaauuuuuuuccuuccccucccuucucucuccuccuccuuuucuaaccaaagggcauuuuaucaacaaucaugcugaauucaauuaauaucucaagcuaaaaaacuauguaauugagguuguaucuggagaagaugggaaaacauuguauaauuuaagcccuuaauugucuguugagcuuuuagggcugaguaauugccuuucauacaaauaaaagcuuuaacucuuuucucaagaguguaccaccguccuuagaaucagguguuuuaaauccaguuucuuuuaauuaaaugggacuguagugaucccuacccuguagagaaaucaacagaacuagagaagcuaagggcuugaucagguuuccccuagaaccuguguugccugccugcuguaucuuccaugucuuucuuauucaacuucuagaaguagagaagguugggacuugaguguagaagaaacaucagaauaauuucaaaaaacaggaaguuggaacuauaauuuuuaaauuauuguauuguuuuuacggauuuuacauguauaguuaaauauuaaaauucaucucuugcaguucaauaaaagcuauaguauagauuuuauuuuuaagaaguuuauauaauucuuuugugaaccaauauguaaaacuagaauauuuauuaaacuaauaauauguauuaguaucaauaaaauauguauuuauuuuuaaauugguaugaaacaaaauaaaaauuuguagacacucuuaaaa

SEQ ID NO: 1238 - RNA, 1133 nt, Homo Sapiens
aaaaaagaucagucaguuuaccucauucaaccuucacugcaaucaaggaggaagcuuuaucaucccuaucugacagaacugaggacauggcugaaggagauuaaaagcacauuuggaaauaccgcuuuagauacucuacaaguuaaccuuggaauaaaccagacuaucagagggcauugucacucacugacggauuucuuucauuccucucugcuuuggcauuaggcagucagccacaucaagagacuucauaagaaacagcccuguaacucauuuguugcuuuccuguaagaauguugucaaggacauuauuuacuucauuacaaagggucuucuuugugcuggagaaacuucucucagaucucugugccaggaagaaugguguuucucucaaacacuggguuugauauuacagauaguauaaacuauauauccaggcacauccuccuuuagugaguauauacaaacuggcuucacuucauuuuuuucaucuuccaacuucuccauaauaauauuuacuuuuaaaaauguucuuaacaaugaauaugaccaagacaauuugaggaaaccaaucauaaacuuugugucaauauaguaagcauguuuccugcagggagauaccacuguucccacuaaaauagaacacaacaaaaggaggcaggagagaaaugaaugacuuaggaccugucuagguugaaaaggcaaacuagaaguggggcacaccuaacuuguuuaaaaagacuuugucaacuauuauuuguguacucuuggcauuucuguguucuccucauuccuauuucauuccuauuccccuuuaauauuuccuuuacauaccugauaccuucccucccaaaaauggugugugucuauguaguuccuugaugauuuugucaacgaauaauaaacccuggguuuuggauaaggaggugaaaagaaagggcucugcuugauucugcacagggcuauacaccacagggcgaggaaaaaaggaaaauccaaauauguuuagucaggauguuuuccuaaacuauugaagaaaucuuaucuggccuccucuuaaaauauguaagaacuguuuccagcugcuuguuauuuggcugugcuuauuuuagaccaaagccaauaaaaaaaau

SEQ ID NO: 1239 - RNA, 990 nt, Homo Sapiens
guacgaugugagcgggcaaggaaacacaagcuggcuuacagguggaauaccugagagucuccagagaggacccaugacagacagcugagacauggauggacacgagccccagagagacuucagguaauucuucucuucaaguaaugccuccccaacuaguacauucuauaaggaugaggaucauaucccuucaugcucaccacucuauccccaaagcccaacacucuacugcuugacugagagcagguauugcagaaagaacaaagagagaggaaguugggcacuccauaaguccauuagccuucaucagaggugaaccucccaacucaauguuugacaugugaaaaaaaaagcagaucuggcuggagcagauucagaaaaccucuuaucucccccaggcggaugaugugcccaccgaccacaucagccacgaaacccagcucauggcaccuggagcugaugaauggcccuggugcugacugcccagaaaccaauccggaaaccaggcuucccacagaagaggcagcuggagagccaagcacucuuggacuacaguccuaggcuggagcugccaauacaggcucugcccagcuaaucuucucugagccugcaaauauuaaaccugacauacagacucaagugaauccagaaaacaggcucacagggcagcugaaaauuccaagugccuaagugagauccagugcgacaguggagcaugugugcgcagaggagacaggaacaacaaccgggaugucaugcgggcgcacuggggcuccuuguggccccagugcacagaauucugguggacccaccaugugugggagcucagugagacucaaaguaagugcaaggcccuccucacacaucguacgcugaagguggagcacacugggaaaaugugcaugcaucaagaagaaaaaugaaaacugauuuugugcaacauuuccacuguucuuggaagaaugaaauaaaugcauaugagcuaugaaa

SEQ ID NO: 1240 - RNA, 2414 nt, Homo Sapiens
cgggaugggaaaacuaugccuggggccgacgcucugcccggcugcugccgcugaggaaagccgggacgcggagccccgccgagagcuucuuugcuccggacgccccuggacguggcgggcagccgcgaggguaaccaccaugauccccugggugcuccuggccugugcccuccccugugcugcugacccacugcuuggcgccuuugcucgcagggacuuccggaaaggcuccccucaacuggucugcagccugccuggcccccagggcccacccggccccccaggagccccagggcccucaggaaugaugggacgaaugggcuuuccuggcaaagacggccaagauggacacgacggcgaccggggggacagcggagaggaagguccaccuggccggacagguaaccggggaaagccaggaccaaagggcaaagccggggccauugggcgggcuggcccccguggccccaagggggucaacgguacccccgggaagcauggcacaccaggcaagaaggggcccaagggcaagaagggggagccaggccucccaggccccugcagcuguggcaguggccauaccaagucagcuuucucgguggcagugaccaagagcuacccacgggagcggcugcccaucaaguuugacaagauucugaugaacgaggguggccacuacaaugcuuccagcggcaaguucgucugcggcgugccugggaucuacuacuucaccuacgacaucacgcuggccaacaagcaccuggccaucggccuggugcacaacggccaguaccgcauccggaccuuugaugccaacaccggcaaccacgauguggccucaggcuccaccauccuggcucucaagcagggugacgaaguuuggcugcagaucuucuacucagagcagaacgggcucuucuaugacccuuacuggacagacagccucuuuacgggcuuccuaaucuaugccgaccaggaugaccccaacgagguauagacaugccacggcgguccuccaggcagggaacaagcuucuggacuugggcuuacagagcaagaccccacaacuguaggcuggggguggggggucgagugagcgguucuagccucaggcucaccuccucugccucuuuuuuuccccuucauuaaauccaaaccuuuuuauucauccaaccaucuauuuauucacuucuuuuuaaaguaucuacuguguaacaggcacuaugcuauucucugaaagaugcagcaguggacaagacagaguaucuguccucaugcagcuuacauucuagcaggagauacaauuuacaaauauacaagcaaauaauauaauauuaugccaggauagaaaugaacaugccaugguugacaguaauaggaauaacaggagacagggaagagguggaaauuuguuucuuuuuuuaaguuugcguuuuuagguuuacuuacauacagugacucuccagauuuuaaguugacaacucagugaauaauuuuugcuuaugugcacacucugaaaccuccauguagaucaaagaacaagcuauuuccaacuucucaccucccuuccccaaaagcucucuuaagaccccucuaagucaguaccuggaaaauuuccauuuuugagcugaguuccaaagaaggaaauagagcaacacaaaggccucgaaaagaggucuccagcaaaaggcucugcaagugcaaagaccuugacaggaaagagggaggggccaagguaagaacugagaagggaggcaugaggcgugaggcuggaagauaauacagaaugucccaggccauggcagagcucguuccauucacgaaggcuuaucagaauacaaagugacacugauaggcggaucaucuugaaucugcucauugcaugagucaagucggccacagacuugagcgcuuuauuauuaguuaaucuuuugcaggcccgcuucucaaugaaugagauacaccaggauaugcacgugcaucugagaaccgcugcucugagauggcaggaauggaucccacgcaaaugaaucgcaccccaagcacagguguugccaguaugcagggaucugggggcuuaagaagcugcaguaaaagugccaggugcuggcgggaugugguagcucaugccuauaaucccaggacuuugggaagcugagguggacggaucauuugaggucaggaguucaagaccagccugaccaacauggcaaaacaucgucuaaaaaaauacaaaaauuagacaggcgugguguugggugccuguaaucccagcuacuggggaggcugaggcgggagaaucgcuugaacccaggagguggagguugcaguuagcugagauccugccacugcacuccagccugggcaacagagugagacuaucucaaaaaaaaacaaaaaaaaaaaaaaaacaa

SEQ ID NO: 1241 - RNA, 2861 nt, Homo Sapiens
aucgaagccccauuuccguaggagcgaagucgaauggcgcccccagcggcuuggggugggaucucagugccucauuccuggcggccccgggagggcgaugccacccgugccuggccccgccgggucgcucccgagcuccgcguuucguucgccgaccccuggaagacugccuggaggcccgggcgccacccaaccacuggcuaggccgacacuuugcgcggacccuggguguaaaagguccccgggucucuggucccgacggagcugugagggagaucaaccacgcccccuccgugggcaccguggcggcagggaaggaaaagggcucugggucucgacucucuucggguuaagaaccgacgggguuuauucuaugcaagguguuauuaacuccaacucucccuuucguucauucauuccauauauguugaacgacaacuuagugccaaaugccggcaugcugaaacucagagagggaagaugucuugcaaguacagcagccacacccagaguuucgcucuuguucccugggcugcagugcaguggcaccaucucggcucaccgcaaccuccgccucccaaguucaagcgauucuccugccucagccuccccaguaucugggauuacagguaugcgccaccacgcccggcuaauuuuguauuuuuaguagagacgggguuucuccauguuggucaggcuggucuugaacucccgaccucaggugauucucccgccucggccucccaaaguacugggauuacaggcgugagccacugcgccuggccuacuaauacuagguuuuauuccgggcccuucacaguuaauguuggaggccucuggaggauggccacaccugggcuauuugcagaagccuggacagcacagcaggcagaguuaaagcaguuaaggcaguaucagcugaagggccacccagcugugcgugugcccaggcuccaagaauaaggagguuggggggcaguccuaagaaaggaagucauuaccuaucggcaacccaggagcagacgcuggcauaacggcgcacacacaguaaaggucagagguucuucuuagaauaguccuuagguguuagucaaacccaugcccugccccaaggaguucauucauucauucacucauucauucacucacucacucacugguucuguuuauucacucauuucucuaucacauauccauuuauugucauucacccacuuauuuacucauacauucauucauuugcucaucaauuuauuugguaccuacauggagccagguacaggucuugauuaaagagaucuggggaggagugcucccaagaaguucagagccucacuggugaaggaaagccauguaaagacagaucuugagaacccaagaucaucaaggaguauccaugaucaagcagagcagggaaggcuuuuugcuuuguuuuguuuuguuuuuaacaugcugugugguucaguaaaauuaaaacaggcacaaugauauccuggaugacaagagcuggaggcugucauucuaacaauguagugagacuggcugucuugucucaugcccaccccuggaaacaugcgcaggaacucaaagcaccuagcacagaggaagugucugguuguuuuaaaggaaaaacaaaaccaaaaaaagcaccuccugcucugaccaccccuauuuccaguuuucccuuuuggcacagcaaagaugaccuugggacugagguggaaccauguaauucuucguaaucccagagucaggcagaccuggguaugaauuccaucuuuacuaacugugugacucacuguguggccaugccaaguuacgaggucucucuguuuccuccuuccuaaaaaggagauaacauccaucucgaaggaagaucuggccugaagagcagucacucuugccuggcaugcagagaaugccaaaucauauuaaugacuggccagaaugaagugcgugaccucaucacuccauaacugacaggaaacaacugcuagggcaagaaaaaagggucuccagugaguauucuuguccacacacauccccacucacguuccuggaccacugcaucuaacugccgcagcagcuaaugaaccuucuggaauaaaggaccaguuucuuaagaagggauugagaccuccaguggccucccacauuguuuccggcaagaauuuaaaaauuauuuguaacauauaguaauaaaaacuaaccacaggcugggcgcaguggcucacgccuguaaucccagcacuuugggaggcugaggcagguggaucaccugaggucaggaguucgagaccagccugaccaauauggugaaacccuguuucuccuaaaaauacaaaaauuagcugggcaugguggugggcgccuguaaucucagcuacucaggaggcugaaacaggagaacugcuugaaucugggagguagauguugcagugagccgauaucgcgccauugcacuccagccugggcaaugacuccgucucaaaaaaaaaaaaaaaaaaaaaaaacuaaccacagcuacuauuuaugaacucuagugccacaccccauuucuucccagguuucacccccucuucccagguuucacccaccccaaccaguguuguuugcaacacuucagcuucucuccucacgaagcacgucuccagagacgccucuuccgcaacuucccagggaagccauuucugccuggacccaccacagcucccaaccugucacgcaccccuggaggguuuugcucuguaauccugauuuagaaauccucuuauaugaaaccacuguaauccacaucugguuagacaauuggaaaaguucauugaaaggagaaauaauaaaaauggcauccaucccuuaaa

SEQ ID NO: 1242 - RNA, 8418 nt, Homo Sapiens
agcaaagucaggcggucggcuucgccagcagccgaugagucucauccuguggauugcccagcgccagggaucaggauccggagagguguccaggaggagcagacccucagaccagaaggcggggugggccgcgcgccugcgauuuuccguccgugguccuggggcagcccuggccagcccaggagaacccgcgagcccagcggcgccugcaccugcggcuuccgggagccgggcggcuuugcgaggcucacuaggucugagaggucggaggccgccagugucgcugcugaaggguggaccaggcgggaucgcggauucugggcuagaucgcagacuugcgaaaagcucucaccuaaaacuguccguuuuacauccguauccaccuguguagaucgguucuuuacugaagguucuuagaaggaaacuuggaagugggagaggugacaauagauauagaaguacguugaugugcgaagauguauuuuguuuuagccagcgaggaaaaaagaaucaguuugauuacacauuuaccaaacauuaagaauuuaauaugguaacuuuuauuucaguauuaaaauagcaauuuuauuuauuacuuuuuuauauacagaauucgacaccaaauuuuggaacuuaaaaagaagauucuuaaaacuuacaauccagguuguucaggcugagaaggaagagagguuggucuugcugucucuggguugcagaggcagaagaaaaucugcauauaaaugaacuccugcagcucaaacccuugcuguucaagggugaacuguauuaccuguuaauuugugucacuaaggaaguaucuuuagaaccgggaacucaacaaucccuuucucguagaauaaauaaauggcaguaagaacuguaaaauucugggaguucugaugaauaugcagucagcccagggcuucccagcugucuucauccaggccugcgccgguguucacagugguccucaucuaagccagccaagaagaucucugucauccacgugacagccagcccagaugucccuagccguccucaucaaggccagccaguuugcuuacacgugugcuaauuggagccagccacccucauagaggccaucccagguaccgacagccauccacacugggcccagcccagguguccacaccuguccccauugagccuagcccugguguucauggcuuuugucacaggacuucucccaguuguuuccagcaguuuccauggucccaggccaggguuucacagacauccucaauggggacagcccaucuguucaccguugucuuaauuaggcccagugcagauguucacacgugucuuccuuuggcucagccaaaaugaacagaacuccugagcgcauaccagcgguuucuagcuguccacauuggggccagcccagguguucguagcccuacguucugggcccaucccaguuauuccaagcuguccucuugggccuagcccagguguccacagccauccuccuuggaugauauaggucuugccuuucauuuuaacugccauucuggcaacugaacguuggcaguaaacgcagcuuaguugucucagaggacucacaaugggauguguuuauaguuguugccuugaaguguguuguggcgaggaugaaauaguguauccuaggaugccaggggaauccaccgucugccaccgcgagcgugagaagccaaucaccuaucacugguaucacuggcaucccggccauauauacccuagaauugcaucaauggaagauucuuaugaacagaaaucuaggguuagcaucaagguucacucuguguuguccagccuauggguuuugacaaacugacaaugucuuuugucacccugacggaauaauuucacauccuaaacaugaccugagcugcaucuacuaauuccucuccuuuucugaggauuccugacaacuauggaugauuuuuacugccucuauagguuuccuuuuccagaauuuuauagaguuggaaucauagaauuacgaugaggaccuggugcaggaagcuucaucugaagauguccugggcguucauauguguuuuguuuuucucuaaaugcagguggacaaagacacagagagagacaguacguauucuggaaucaccccuaugcugaggaaaaauucuaguguugacaaaggugacacuuucuugccucauuuuuucuggagagccacucugguuugaacuuccugccagaaaugugguucaagcacuuuugucuugacaagugaagaaccuggucaagaaaugugacuguugacucuggugcuuggaaggaacagggucauuuggauagaagaggguguugugaaucagaguugggagguauggaggaaugacucaauguggaaugauugugaaugucucugcgaguuugugugcuuuuccccagaaaauaaggaaggaggagcccuaagaggcugccagggacacacagccugcacugcuguugagaugaaacggcaacuacggcgacuacgggagcuccaccuauacagcacauggaagaaguaccaagaggcgaugaagacauccuugggaguuccacaaugugagcgugacgaaggcuccuugggcaagccauuguguccacccgagauacucucggagacguugccaggcucugugaagaaaaggguaugcuuuccaucagaagugcuggagucagcgugagcaugaacagcaacugacuccauggacacauacaucguguugaaaaggaagaguggaaggacaaauaagcuaagugcgggucauuuuuaaaugguaggauaauugaguauuuucaaaucuugguuuaauucuguuugacucaaagguucaucaucuagaggaguuuauagcagaacaucucccugaagcauccaaucagagucuccucacuguugcccauucugaaaggggaauuucauuuuccugcagacgcaggcacccaaaccaacggugaccuggaagaccuggaggagcaugggccagggcagacagucucugaggaagccacagaaguucacacgauggagggggacccagacacacuggccgaauuucugaucagggauguacuucaggagcuguccaguuacaacggugaggaggaggacccagaggaggugaagacauccuugggaguuccacaacguggugaccuggaagaccuggaggagcaugugccagggcagacagucucugaggaagccacagggguucacaugaugcagguggacccagccacgcuggcaaagagugaccuggaagaccuggaggagcaugugccagagcagacagucucugaggaagccacagggguucacaugaugcagguggacccagccacacuggcaaagcaauuggaagacuccaccauuacaggcagccaccagcagaugucagcaaguccuuccucugcaccugcagaagaagcaacagaaaagaccaaaguggaagaggaagugaaaaccagaaagcccaagaagaaaaccaggaagcccagcaagaaaagccgguggaauguccugaaauguugggacauuuuuaauauauuuuagagaccucugaaggcaagugaaggaugcccugagaacaugcuccaggaaacagacacccacuccauagcagccccugagccugcugggcugagcccuccacaggcugcuuagugagggagacacugaggugcuggucgcacccccaugugcaggacuccaagggcuuugcacuguguugucugcaguaacucuucagcucaccaacaucucauuuggggggaccuagcucugucuucccagccccuugaggacaacagggagcaucacuaguucauccugaggagacacuaggguugacaugaaucccccugguucaggccuccugggaaaggugugagagggauggaggcacccccaggcuccuugucacacaagcgagcagcccacccgacccaguauugcaggccagcaggcccucaguagguccuggugucaagcaggggacacggcaggauccaagaagcacugaaauguguccagucccaggaguccuucagccucuggggggucugggggccuccaguuccagggguccuucagccucugugggggccugggguggccucauggcccccuuuuucaagaugagguuggaggcuucuguauguagagggcacuggcuugggccaaaugccaacaaaacaaacccuugaagacauuucagggccaugcucacuugggaggguuugaggacaugauuuagcgagccucuguuuuuuaaauauauuuuccaaucuugaaauaagguacuccaggaagcuaugcauguucaacgugcagcucuucuccaggaagcuaugcauguucaacgugcagcucuucuccaggaagcuaugcauguucaacgugcagcucuucuccaggaagcuaugcauauucaacgugcagcucuuccgucuggauggcacagaggaucuggguggcaaggcagggucaccacccccacccugugucaugagaccuccugcuccucuuagggcccaggggcaugggacucugccuguugauccugauuccucgaccaccaggaagggccccgacguggggaugucaacauggcucagacuugauguggaucgugaucauuucgggaaauguguuacuccaaaaacuuuuauaaucuuugcuuaauuuguuuuuaaauacuuuccuggcugggcgugguggcuuaugccuguaaucccagcacuuugggaggccgaggcggguggaucaccugaggucaggaguucaagaccagccuggccaacaaggugaaaccccgucucuacuaaaaauacaaaaauuagcuaggcgugguggcgcacucuuguagucccagcuauuugggaggcugaggcaggagaaucacuugaacucaggaggcggagguugcggugagccgagaucaugccacugcaccccagcaccuggcuacagagugagacuuugucucaaaaaaaaaaaaaaaagaacaaaaaaauucugacuuuaaccucuguuuuucagagggcacaaauuguucuuguauuguuuccauuuuacauuuuuuucuugaaguuauuuuccaauuguuuucauucuuucugaaguuuuguuuacucgguuuuaaguuuuuguaauuuugauagacuucuuuugugcuuucauuuucuuaaugacuuuuaccucauuuuuaaaacaaauccauaguaugauuuuuuucuuaauuuuauugacucauuuaugucuuagucuuuuuuauuacaaauuauuuauuguucagucacuaccuuagagccuccuguuuuauuuuuucuuaauuuuauuaaaggaugauauugaugaugaaaugucuuacgaugaucauuuagagguuuauuucgaacaacuggcaauuccaggaaugauggaauaaagcauacgaaguagaaggacuggaaccuccagaaaaaguacuuuaaguuaccuacaggugauccuagucagguaugaauugauaagaaaugccugcaccuucccuccuuccuaucuuucccuugccuacagaaaauuaaaaggcaaaacaauggacaucuacauauucuucauucagaucaaccaguggcuagcauuugccaccuuuugcaguuucuuucucuuuccauaaguacuuucuucucugaaucauuugaaagcaaaugaaaacaguagccuaaagugucaguuucaacccgaaaauaacagcucugauuucucauggcucacacucgucugaaaugacucggguagaggcugaggaaggcuguguuguuugucuaccugggacuacaccuacugaaagaaguucucaaguucugauugaguucuaaaauucuuuugaagauuggaauucuucauauguaaaaagagaagagaaagacauucuugauuuuggugacuagaguuguagaugcuggaagcuuugccacuaacauugaugaaccagaugcaugucaccagcccaucacggugauucuuaaugccguuaaggcaccaugggccggcacugccacguuuuccaaggaaccugccagagcuccugcggaagcugcuccucgggcgauggagucccuuugcugcuaggcccuucuucagucaccacaggaugccugccauucaugaacaggaaggagaggacgggcuuugaauaaaaaacaggauccaggaaauauuugugaggccauuuggacuucagugugaaaugguguuaaaagaugaagucauuuauucaagaaguaaaccucugccaccuggacugugcucagacauuucauugauuuuguuuaauaaacauuuucuggcuuugggaggugucucucuugguagagcacagugucaaagauggacaagauggacacauaguccauuauuugguauuguuuguguaugggagcggaccacaaauuaauguuuggagaacaauuuugucauaacacacuguugaggcucaguuguacagaacuggaaaagucuuucagcuuggcacauguccugauucagccuuuguuuaacauacauuccaauccggauucuaucuucacuggcuacaaagaccaccugauacgugcaccacgacacaggagcugcuggagaggggguaguguuaucaccucaaacccacagccauauuuuucaaaagccagcuuagagagagguguacugauagcugcauagagaacaugcaguccauccauucuucccagugauguacauuucucaaucaguaaccacgugguauaccagccuugagugucacaucucccaaccauaccaaauggaucaccuaacuggagguggggggggccccucagaaaugagauuucguauuuacuguaaaauugccuuauuuuuucuuuugagguggagucucacucuguugccugggcuggagugcaauggugugaucacugcucacugcaaccuccgccuccuggguucaagcaguucuccugccucagccucccaaguagcugcaauuacaggcgcaugccaccacucccagcaaauuuuuauauuuuuaguggagacaggguuucaccauguuggccaggcuggucucaaacuccugaccucaggugaucugcccaccuuggccucccaaaguucugggauuaaagguacgagccaccgcaacuggcugagaaucuuuuuauuugcugauuugucucuuguguauuuucuuuguucagaugucucuucagaucuuuuucucacuuuuaaauuguuuuuuuaauuguuaagaauuuucugucuaguuuagauauaagcccuuuaucagacauguguuuugcaaauauuuucuccuagucuguggcuuguauucugucucuuaacagucauuuuauuuuuacuuuugaaacuaaagaagaagaauggucagcuuuccguuauucuuguaacaguaauggcagaaccaagucugcuaaugcuacauugagcaaagaaagucaccuggucaaguccaacauuaaugaaaugggguaguacaugcaggcggcguugggguuggggagggaacaaaugcuucuugagaguaauauaaucugccauaccauccaggaaccuacaauggcuaucuauuaccuuauucucugguuuguuuaauguucaaaucuuuccuaaagauccuucaacuuuucuggaagaaucuaaucugauaacaccaucaaaaacacauuacuucuuuuggcauaauuuaaauuguaagacaucauucacauuuaucaauguuacauauauaagaacucacccaccauauuccuccuugaggaauuacagcauguaauucuauaaccauuuuuauaaucgucuaacaauuuuauaauggauuggcugcuaucaauuuuuuaaaagucauggcuucuccagucauuucuugcuuaucaaaauuauuucaugagaugggucuauccuuguauauuugaaaaugagguuugcuuccuucuacuuaaaaaacaacuugaacauaccuguuuggaucacauggucuuguccugauaacuuggaagagguugcuucagcauuauucuuauuguuguggugguuauuauuaacauuguuucauauuccguuuaaaaaauuaaaauuuuacacaagaccaaugucuucuuuucaauuccaguacagucuucagaaguaacuaaugcuauuggcuuugugcauuauaauuucagaccauuguauaugucuuuaguuauauguacaguauacacacauaugugucauauuauuccauuuuuucuagcauuaaacauugcuaugaauauccagccacuggugcacagccauugccacuugugcccccaggggaucuugucaacuccaguauguccccccagcacuguguuaucuggcauaauaaa

SEQ ID NO: 1243 - RNA, 1058 nt, Homo Sapiens
ggcauugcacuuccuucugcuguucagacaggcaaaaggccaugggaaguuucaacaccaguuuugaagauggcuucauuuuggugggauucucagauuggccgcaacuggagcccauccuguuugucuuuauuuuuauuuucuacucccuaacucucuuuggcaacaccaucaucaucgcucucuccuggcuagaccuucggcugcacacaccuauguacuucuuucucucucaucugucccuccuggaccucugcuucaccaccagcaccgugccccagcuccugaucaaccuuugcgggguggaccgcaccaucacccguggaggguguguggcucagcucuucaucuaccuagcccugggcuccacagagugugugcuccugguggugauggccuuugaccgcuaugcugcugucugucguccacuccacuacauggccaucaugcacccccaucucugccagacccuggcuaucgccuccuggggugcggguuucgugaacucucugauccagacaggucucgcaauggccaugccucucuguggccaucgacugaaucacuucuucugugagaugccuguauuucugaaguuggcuugugcggacacagaaggaacagaggccaagauguuuguggcccgagucauagucguggcuguuccugcagcacuuauucuaggcuccuaugugcacauugcucaugcagugcugagggugaagucaacggcugggcgcagaaaggcuuuugggacuugugggucccaccuccuaguaguuuuccuuuuuuauggcucagccaucuacacauaucuccaauccauccacaauuauucugagcgugagggaaaauuuguugcccuuuuuuauacuauaauuacccccauucucaauccucucauuuauacacuaagaaacaaggacgugaagggggcucuguggaaaguacuauggaggggcagggacucaggguaggaggugaaaaaaugagcaguaaaauuuucuguaauagcucuucaaucacagaucuuucccuguuccuuggagggcaguugg

SEQ ID NO: 1244 - RNA, 105 nt, Homo Sapiens
guggcguuguagggcuccaccaccgugucugacaccuugggugagggcaugacgcugaagguguucaugaugcggucuggguacucuucccggaucuugcugaug

SEQ ID NO: 1245 - RNA, 105 nt, Homo Sapiens; identical to SEQ ID NO: 1244

SEQ ID NO: 1246 - RNA, 1742 nt, Homo Sapiens
gcauuuuaaugucccucugcuuggauuugcuacuuaguuuuucuuuaaucaggauagggcagagagggagaccgaaggagagagcgcagagagggagaaugugucugcggcccucaaucucgaugaagauaacacgaggagugcacaggcaagugcccaguugccagcaauugcuucaaaagcccauguucuucuuuucccccauucuuaggcacagccaaaauuggucagaaaggggaguaaagugggacacgagcuucaaaguagggaaaccaaagaagggagcauccacguccucucucugcagcuucucccccgcguucuucgggcgaauccgagggacgggcgcugcgcuggggaaaguuugucccacccgcguuucgcagcugguugcaaggagaggaggaggagagggagggucaagcucggagccugugaccgcacggaugaucgagccggcgucgcgcuuaccucgcaguccucguacuugauauuauccgucaauuuccaaagcauuuucauggaucggcgugaacggauaugccccucucggucucgcacccaaguggagcuacucucuggcucuuuaccaacagccuaaucgccucauuagcauaucaacaauaguccaauugcucgccaguaccacaaucugccgccggccgcuccgacacagguauaaaggccucucuacgccgcgaacuugcuucuagagcgcacuccagccugcgaacugauaaaaccuuccucgagcuccgccgcgaggcccugccccaacacccccucucuuaccccaauuccgccacauuccccuuccuuucuuucuccgcuuccuuuucuccagagaugccuucugcaaagcccggcacugcucaagguccaagcgccacgccuggggcccagcuucuagcacuucucccuuaacccugcuaccacgauccgagcugcccuuuuggccccgugcaauuuuauuagaaaucauuaucccuuucgcaauuaaacauaaccaccaaaccaagaccggcgaagucacuccaggauuuuuucccaacaagggaucgccuccgcucgaggcagccacccccucgggccgcagcgccuugggaguuuuauuggcuuugagcuuucccccagguuggagauucugccaagcggcuccgguggcucugcugggguuugcaaucccuuaauugcagcguguaaaauaaaaguuguacccugaagagguuacuugacagcuccagggguuaaacaauuuuucuccuguuugugugaagcuagggccaacugacaguucaaauugguguucaggcuaagguuuccugggugcaacguggacacgaauacagaacuccuauggaacugcacacccgcuucugaaguugagccuaaaaacagacgugugugugccugcaagucuagauaccgucucgugcgugcaucaaaauaaaucaccgggaaccgacuuuuagcuguguuaaucugcucuaguuuucccaagauuccccuuuuuaauuaaagcagggagaguuccuucaugauuuggugaugcuacuaacgcgggcgugcucgcgaggcagagcccggcugccgcggaaccuggaggccugggagccaccuacucguccagacuggucaguccgggcuuuuggacuccucaccggggccugcuggguccucuggggcuuuuaucccuuucgguuuugggauuuuuuuuuaaguaagaaaaaaaaaaaagaaaa

SEQ ID NO: 1247 - RNA, 191 nt, Homo Sapiens
acgcgaucgcuggggagcuggggucgcugcgcucccggccugcaguuaccugguccagcgggaugcccaggagcucgcugagcgggugcaggugccccagcuuugucccugaauaugugcuuaaucugccagccagggauccagaagcaccaucucccugucugcauucugaucacccaccucacuuccag

SEQ ID NO: 1248 - RNA, 2254 nt, Homo Sapiens
acuuugugguugcucguagugaguugcgcucgcuaugucuggacguggcaagcagggaggcaaagcccgcgcuaaggccaagacucgcucuucuagggccggucuccaguuccccgugggccgagugcaccgccugcuccgcaaaggcaacuaugccgagcgggucggggccggcgcgccgguguaucuggcagcggugcuggaguaccugaccgccgagauccuggaacuggcgggcaacgcggcccgcgacaacaagaagacccgcaucaucccgcgucaucuccaacuggccauccgcaacgacgaggagcucaacaagcugcugggcaaagucaccaucgcacagggcgguguccugcccaacauucaggccgugcuacugcccaaaaagacugagagccaccacaaggcgaagggcaaguaacuaucuguacuaguuuguggcagcucaaguaaaaucgaguccaaaccaacggcucuuuucagggccacccacgucuucucuaaaagaacuuaacauuuauuccaugugaaagaaagugagacauggacaagacucuagucauaaauuacccaucuuuuugaaaacaguguagcgaacaccgcagauuuaaaagaaaaacuagagggaaggugguccagauuuuaccacgcuuaaaaguuaagaugugaacaaaucucuuaggccauuacuuaauuuuaaacuuaaucaguguguguccacagagcaccaguggcuucgugaguucuugaagcacuuuggcccaaaagaguuaucgcccgggcuagaauuuagcagacagcuguuccacgcgggccagggcggcaugaagaagucccgccgcuacgugcccggcacaguggcccugcgcgacguucggcgcuaccagaacuccgagcugcugaucagcaagcugccgcuccugcgagagcucggcggugacgccgcugcacgagagcgaggcugaagaacuuugugacacaauaguccaccucccugcaaaggcucugucagagacucacaucuuuccugauggauagcugugaagcauucucuuacccacccuacugcauguugcaaaguauuccuuuaaaaugaagugaguaaaauacugggaugacguuaucuggagcccaagaaagauggcucauuuggaaaggccuaauaucccaaguugcuuaccuagaagaacuugacaggauaguuaauaauaaaccuuaaaacccaugaagaaaucugagguaaaguguuagcacacagacuguuaaaaugucugccucacagauaggagggaaaauauauagaggauuauaauaugguucaacaaauguugaugaguauuagaaauguacauuagaaauauuagaaauguuuaugacuauuagaaaaguacaggguauugggcguuccugacacaaacugaggccuccuagcaagacuggcaguuuucuguaaaggaggguuauuuacuacgguagugcaaauaacuuuugguguuguagcuaaauaaggaauacucaugccaagauugcacaauugugccuccucccucuguucacugaacucugauguaauuuuuuuuuuuuuuuugagacggagucucgcucugucgcccaggcuggagugcaguggcgcuaucucggcucacugcaagcuccgccucccggguucacgccauucuccugccucagccuccugaguagcuggggcuacaggcgucugccaccaugcccagcuacuuuuuuguauuuuuaguagauacgggguuucaccguguuagccaggauggucuugauguccugaccucgugauccaccggccucggccucccaaagugcugggauuaccggcguaagccaccacgcccggcccacucugaaguaaucuuaagaagacguuaacucauuuuucuuguguauuguagacacuuuuggcugucugguaacauggaaaaucucagaaugauguuuuaaguauauaaaaugccaaacaaaguuaaauuacaguuaucaaaguauuuuuaaaacuucauagugauaaaugagacuauauaguuauauuguuaauauaguuaacacauuacaugauuuggugagccuaauugcuguuacuaauuagaggaguaaaaauguuucacgauaacucagcaauuguaaugagaaaugaaacaucuaaugucuuuuggguuacaaaguaacagguacugagauuuguggccuaaauucauaauaaagugaaauguucaaguuc

SEQ ID NO: 1249 - RNA, 3095 nt, Homo Sapiens
cgccaggggaugcaaacccuucugccccuuuuugcuaccccugaagcuuacuguuaguggucgaguuuuucuggaagugggcuuccgcgaucgcggggaccaacgcccugagcucuugugcccaaaggggaucgccagguuuuuugaugcggaucgaaagggacuggccccggagccuacaaccugacgcaggugggacuuggggaaaugucgagaaaccuaggucugggacuugaguuggcuuccagggcacacauucuuguucagaagaaacacauugcaaaaaucgggaggugacgggcagaugaagugucggcgcuucgccucgggacuccagugcaaccuauggggcuuuuggaaaugaggaagucgaugacucugcagggacuccucugacccaggagcagauggcgcucgucugggcacuccccaggagaaaaggugcaucgggaagcagccuggcuuguggaugguggacaagguggaggagagagaauuccuuggcaguagcauuaugaacaaaugcagggcugagaaacagcaugguggccuugacuaaguuuauggcgacagcaguugggguaacaugugaccuggaucugaucauugugauucaagucagcgucauuuaggguuuucgggaaacauuuuuugaaagggagcaacuuggcuggaacacuccaucaauucuuugcccugugcauuuuugcccuucuuucugccucucaggaaugcagagagaauuccuggaggaacagcagcuaucauacauccgugaugaaagccaugggacaaaggcaauugagcaagaagacaggagcuggggacauucuugacaguagugccaccucuggaugauuuaccuugggaccucuuauuaaaugagauaggacuucuuccuguuuaauccacuggaguggaauuuucuguuacagugaaugcaguccuaauugaugauauuggcuaauacauauuagcaccugcuaugucccaguacaguuuaagcauuuuaucuacuaauguuuuaaauuuucucagugaccuuaugagauaggccaaagguucucagagugugguuccuggaccagcaacaucagcaucaccuggaaacuuguuagaaauacaaauuuuagggccuggcccuagacccacugaaucagaaacucuaggggugaggaccuagcagucuguuuaaaaagcccuccaugcuauuuugaugaaugccaaaguuggacagcuacugagauaggguauuguuauuauccccauuuuacagauaaggaaacagcugaauuuaugucacuugcccaaugucacacaacuagcaagacugacuccuugaagcucaucacauguaagaacugcuuuagagcaguggucuucaaacuuugaaagcauauccuguugaaaaauuauguauccacuucuacauuuuuaaguugacaucuaaaaauuucacaucauaaguuuaaacaguuguaaaaaaugugauuucugguauauugugaauuaugacauuuuaaaauguauuccaucacuccucuaaauguauucagugguuucuaaauaccauagugauuuaaaucuaucaucaauuuaaaaaaaaaaacaagcuuuuuuuuuuaacauuagauauuuugcaucuuuuucucucuuuuuuuuuuuuuuuuugagacagacucucacugugucacccaggcuggagugcaguggcacaaucuuggcucauugcaacuuccacuucccagguucaagugauucuccugccucagcuucccaaguagcugggauuacaggcguacgccaccaugcccaguuaacuuuuguauuuuuaguagagacggcguuucaucauguuggcuaggcuggucuugaacuccugaccucaagugaucugcccaccuuggucuuccaaaguacugggacuacaggcaugagaaaccaagcccggccaucuuucucuuuuuuacuugaauucagucuuuuuauucuucuuccauuccucucucucucucucuuuuuuuuuuugagacagucucacuaugucacccaggcuggagugcaguggcgcaaucucggcucacugcagccucuaccucccagauucaagcgauucuccugccucagccuccugaguaguugggacuacaggugcgugccaccaugcccggcuaauuuuuuuguauuuuuaguagagaugggguuucaccauuuuggccaggauggucucaaucuccugaccucgugaucugccugccuuggccucccaaagugcugggaucacaggcaugaaccaccgcuccuggccucuuucuuucuuuucuguucuuuuccaucugcccuccccaaacaucucccucccuaccucccucccucccuacuuuccuugcuuccuuccuuccucucuuucuguuucucuauuuuucuuuuuuuccuucuuuuuugagaccaucucacucuguugcccaggauggaaugcaguggcacaaucuuagcucacuacaaccucugccucccagguucaagcaauucuccugccucagccucccaaguagcugggaccacaggcagaugccaccacaccaagcuaaaguuuuuuuuuuauuuuucauagagacaggggaucucauuauguugcccaaacuggucgugaacuccugggcucaagugcucugccugccucggccucccaaaguguagggauuacaggcgugagccacugugcacguugggacuaauauuuucuuauucguauuuccauggcagaauauuccucacugcuagaaugagaccagaggucaaaaucagcucuaugucuguuugucauucuuauggauaugagaaauuguguucacacaaguagauaggaaugaaaggaauuuugaaauagaaaugcaguucuaauuuuucuaacuuccauauuacgugccaaaaaucacauaauaaucuaucauaagauucucuaguccucucucaucuggugaucuucuuuuccacgcuuucuuugcaacccccucauguggccaacauuuagaguaauguuuuccaacuucuuuuucuucagcucacaguaauaaauacauuuuacaucuuga

SEQ ID NO: 1250 - RNA, 547 nt, Homo Sapiens
cuuuucgcgcccaguagaggcuauaaaauguacguuuuucuaguuucacuucagucuuucuugaccguauagauaauaggccuuuugccaugucugggcguggcaagcagggaggcaaagcucgcgccaaggccaagacccgcucuucucgggccgggcuucaguuucccguaggccgagugcaucgccugcuccgcaaaggcaacuaugcggagcgggucggugcuggagcgccgguguaccuggcggcggugcuggaguaccugaccgccgagauccuggagcuggcuggcaacgcggcccgcgacaacaagaagacucgcaucaucccgcgucaccuccagcuggccauccgcaacgaugaggagcucaacaagcuucugggcaaagucaccaucgcacaggguggcguccugcccaacauccaggccgugcuacugcccaagaagaccgagagccaccacaaggcgaagggcaaguagaagccuggauuaguuugcagcaacucaaucccaaaggaaccaaaggcucuuuucagagccaccua

SEQ ID NO: 1251 - RNA, 446 nt, Homo Sapiens
augccugaaccagucaaaucugcuccagucccuaaaaaaggcuccaagaaggccauuaacaaggcucagaagaaggauggaaagaagcgcaaacgcagccgcaaggagagcuacucuguguauguguacaaggugcugaagcagguccaccccgacaccggcaucucuuccaaggcuaugggaaucaugaacuccuucgucaacgacaucuuugagcguaucgccggagaagcgucacgccuggcgcauuacaacaagcgcucgaccaucacuucgagggagauccagacggccgugcgccuacugcuacccggggaauuggccaagcacgccguguccgagggcaccaaggccgucaccaaguauaccagcuccaagugagccucucgcugcaguaacaguuccgccgugacccacaccccaaaggcucuuuucagagccgucca

SEQ ID NO: 1252 - RNA, 942 nt, Homo Sapiens
augaauuggguaaaugacagcaucauacaggaguuuauucugcuggguuucucagaucgaccuuggcuggaguuuccacuccuuguggucuucuugauuucuuacacugugaccaucuuuggcaaucugaccauuauucuagugucacgccuggacaccaaacuucauacccccauguauuuuuuucuuaccaaucuaucacuccuggaucuuuguuacaccacauguacagucccacaaaugcuaguaaauuuaugcagcaucaggaaaguaaucaguuaucguggcuguguagcccagcuuuucauauuucuggccuugggggcuacugaauaucuucuccuggccgucauguccuuugauagguuuguagcuauuugucggccucuccauuacucaguuaucaugcaccagagacucugccuccaguuggcagcugcauccuggguuacugguuuuaguaacucagugugguugucuacccugacucuccagcugccacucugugaccccuaugugauagaucacuuucucugugaagucccugcacugcucaaguuaucuuguguugagacaacagcaaaugaggcugaacuauuccuugucagugagcucuuccaucuaauaccccugacacucauccuuauaucauaugcuuuuauuguccgagcaguauugaggauacagucugcugaaggucgacaaaaagcauuugggacaugugguucccaucuaauuguggugucucuuuuuuauaguacagccgucucuguguaccugcaaccaccuucgcccagcuccaaggaccaaggaaagaugguuucucucuucuauggaaucauugcacccaugcugaauccccuuauauauacacuuaggaacaaggagguaaaggaaggcuuuaaaagguugguugcaagagucuucuuaaucaagaaauaa

SEQ ID NO: 1253 - RNA, 2378 nt, Homo Sapiens
cuuuucaggagucccuucuguuauuuagcaagacacacuacuacaauggagaaaaaagaugcccccuccuucaagcccugagaucuucaggacuuuggcgaaaagucugcgcccgaagagacccaggaaggauucuuggaauuguaguccaaaggcaucccgccuucugcgcagacucacaagucccuguggacggaauucuugaaguguagcgccgcucaguccuuccaccggaaguguccgaucggaaucagcccuguccgagaggugaguccggguuuggggauccagauguccagccccgugucccccuccaaacauccagucccucucauauugccuuugaaauuagcagccucugggugaccagaccuuggcccucagaggaaucccggagaaagguagaaccagcuucggcguugggaacgcaggcgcgcuuacgcauuuagugaggguuuggcggucuccauaguuaccgccgccgcgcgugacgucauaguggagcgcugagggcuugguggcguggggugggggcuguccuacugauccugaauuuggggucacugguaagaggaguugcccauuccagccagguggaacggggaggggugccacaugucucagaucugccauugucugcgaaaagaaacugcugcgaggaccauccccaauccccugcuucccuugggaagaguaaccgccguuuuguaggacacuuggggacaaccccgcuuguccugaaauuuauugacacgguaaauaguauuuccugugugccgaggaugcaguuaaaccaacacugacccccugcccuugagaaacacaagauggcuacagaaccaaagaaagcugcagcccagaacucuccagaggaugaaggacuucugauagugaagauagaagaggaagaauuuauccaugggcaggacacuugcuuacagagaagugaacuccuuaagcaggagcucugcaggcagcuuuuuaggcaguucugcuaccaggauucuccuggaccucgcgaggcacugagccgccuccgggagcucugcugucaguggcugaagccagagauccauaccaaggaacagauucuggaacugcuggugcuagagcaguuccugaccauccugccaggagauuugcaggccuggguacaugaacauuacccagagaguggagaggaggcagugaccauacuagaagauuuggagagaggcacugaugaagcaguacuccagguucaagcccaugaacauggacaagaaauauuccagaaaaaagugucaccuccuggaccagcacuuaaugucaaguuacagccaguggagaccaaggcccauuuugauucaucagaaccccagcuccuaugggacugugauaaugagagugaaaacaguagauccaugccaaagcuggaaauuuuugaaaaaauugaaucacagagaauuauaucuggaagaaucucaggauacauaucagaagcaucuggugagucucaagacaucuguaagucugcaggcaggguaaagagacaaugggaaaaagaaucaggggagucucagagacucucgucugcccaggaugaagguuuugguaaaauccucacccacaaaaauacagucagaggugaaauaauaagccacgauggaugugagaggagauuaaaucugaacucaaaugaauucacacaccagaaaucuuguaaacaugguaccugugaccagagcuucaaauggaacucagauuuuauuaaccaucaaauaauuuaugcuggagaaaaaaaucaccaauauggaaaaucuuucaagagcccaaaacuugcuaaacaugcagcaguuuucaguggagauaaaacucaucaguguaaugaaugugggaaagcuuucaggcacagcucaaaacuugcuaggcaucagagaauccacacuggagagagaugcuaugaauguaaugaaugugggaaaagcuuugcagagagcucagaucuuacuagacaucggcgaauucacacuggggaaagacccuuugguugcaaagaaugugggagagcauucaaccugaacucacaucuuaucaggcaucagagaauucacaccagagagaaacccuacgaguguagugaaugugggaaaaccuuccgagugagcucacaucuuauucgacacuuuagaauucacacuggagaaaaacccuaugaaugcagugaguguggaagagccuucagucagagcucaaaccuuagucaacaccagagaauucacaugagggaaaaccuauuaauguaaggaacuuaaauuuguaaguaaaugcugaggaaauggcacaauaugaaaaauauuaaauaaaaaauaaauauugggcaagauggaagacugaaa

SEQ ID NO: 1254 - RNA, 2141 nt, Homo Sapiens
ggauuccagggcugcucaggagacgccuccauccuggcguggaugaccucaggaucagccccgucugccccacucagcccgcagccugguccccgaaagcgcucagucagaauccgagagcacuguggcggcgcccccguguggccacaggacugaagacagaggaccccgcuccccuuucuccccagccaggacgucccaggcucucccccuguuccccgcaccuggacgggacucugcacagaagagagucucccggucucgugucaggcucugaguucauccagcuucccaaaauccauguugauaugaacguuuucucccacaacugauugacuggacuuuugucucagggcagagggaggccuccagaccaaaacagcaggaucaggucuggagcugacucaaccccaaacccuugcuaaugcacgacccagucccccagccuccaggaugggaccuuggccuccuguccccucccuuguuccugccacugcuccugcagguggaggcugcucaucccaggaaucagucugugagcuccaaccuuggggccucgguccaggaaggagggaggcuccagagagcagaagggagaugaaauggaucauaagagaagaaggaaucauaccaaacacuggaacugaccuuugugaugcucaggaauguccugaugucagcggagaugaaggaaaaccagagauucaaaagucaaaggaaagggccauuuaccauaauucauaucauacauauuuccuggaaaaaaaaagaaaaauuccuuggggaaaaagcaucaaaaucaucaggaagucuuccacacagaaaugacuucauuaauuugaucucugucauucuuucuuuucauucauguauuauuauccauagagauuucuauccuguggguuuuuuauuuaauuuuuguuuguuugguuuuuucagacacagugagacccugucucaaacaaacaaacgucacaggcugcagugcaguggcacaaucauugcucacugcagccucgaccucccugucugaagcaauccuccagccucagccucaugaguagcugaaacuacaggaacaugccaccaugcccaacuaauuuuuuaaaaaauuuuuuuguagagaugagguaucacuauguugccgaggcuggucucaaacuccuggguucaaacaauucacccaccuuggcuccccagaaugcugggauuacaggccugagccacguacccagccucuaucccauguuuugauucaucaucaucuccuaagcccuuucccagcaucgauagucuacuaaacaugccaugauuaaauuauaucucuauaccuugauauaaacaaaaaauuauaugagcaguaaagacaaauaugaaaaaguaaaauuacugccaaaguuauuaggaggauaaccuaaauuauuuggguaggaaaaucuuucuuuuuuauuuuauuuuuuuuuccagccagggucucauucugucacucaggcuaaauuacaguggcccgaucauggcucacugcagccuugaccucccaagauucaggugauccucuugccucagcccccugaguagcugagacaacaggcaugugagacaaugccuggcuccuuuuuauauuuuuaguagagaugggguuuugccauguuacccaggcuggucucaaacuucuaggcucaaacgauccacccaccucagccucccaaagugcugguauuacaggcaugaggcacugugccagccuuuuuuuuuuuucacaucugcuggaauggaaaauauuucuuaaaugagacacaaauguaucaaauugaaaauguuuaaacuucaaaggacuuacauacauauacagucauucuucgcucaauggugagauagcuucugagaaaugaguccuuaggugauuuugucauguguggacaucauagaguguccuuacaugaaccuagaugguauaaccuacuucacacuuaggcuacgugauaagcccauugcuucuaggcuacaaauuauauagcauguuaccguauggaacauugcagccaauucuaacacaaugguaaguauuuguggaucuaagcauguguaaacagagaaaagguacaguaaaaaugugauuaacaaaaagaucuuuaaaaugg

SEQ ID NO: 1255 - RNA, 1180 nt, Homo Sapiens
uuuucccuuuugccauguaaugcaaccuacucgugggugcccaggauugagauuggacgucuuugggaaccauuacucggcccaucacaucugaguauguugaagucaccgaggaucaaggagacagcacugcuggagagggcgauagugaaccaggaacuacaagagucaggacugagaggaacggccuggggcccacagggaauggcugcaaugaggggaguggggccugaaucugaugacagcuuugggggcuuaggaaggaaggaggcagaaaggucugagaaccacagugaggagugaggaugccaccccaccucugggccaaggguacaaggucccugugcaaacucccccaugugggaggacuuuggaagggaccacauccucuggcagacacagacaucgcuggagcugugagguccaggaacauccugagacaggauguggagguuuugcugaucaugggcugagaauuccaaggggcacagcgggaagacuucuggauuugggaaugggguauggggagacaaaauaggggugugcagagccuuguggggaugugaaugcaggguguuugggggacccagugugacugacacaaacagggaaaaggcaugaugagcucaguccugguggacucaaggcagaugauggugcugaggcugugggagacgagggaggaggcucagggguggcuuucaccugggcucuguccauggaggugaggacagggagauaguugggccucagugcuguguggacccuuucuugucucccugaugacuggauggagggccuggaggaagaggggucuuagaggauucacucaugucccugggggagggggacucacuccaggucucaggucugcacugacacauuuguuuguggcuuggggcugccugcuauaaacuauuggggguucguccauuuuggaguuauaaccuaaggcagaaacucagaugguucaaauguccucuucaugaagcaauguuaucagcguaucauuuagauugucuugcaagagucucauuuguuguuuuucuaaaugccugccaauauuguuugaaaaucuacaaaugugauaaauguaucuucaaaguuaacugguugcagguuguuuaaccuuauauguacaguuucacauauguauaaaaacaguaguuugggccucuua

SEQ ID NO: 1256 - RNA, 223 nt, Homo Sapiens
cagcucucgguguccuuuuggggaggccccgggcccccuacucaccugcagggcagggcuccccauccacaccguugacacagggaaugggcacguucucauagccccgagccacgucccugcagaagacgggaagaaggggcugggaagcuggaaaagggggugaggagcuacuccagguauaaggaagagaguuggggagguuccuggggcugggggcagg

SEQ ID NO: 1257 - RNA, 6490 nt, Homo Sapiens
aguuagcccagggaggaaggggacagaaugacagcaugguuauaucaaugguccaauucuugguuccaacccuugauuguccuucgagagcaccacccauuccuuacaacacaucucuccgcuucauuuugggaguuuugaaguuauuaaaguuauugauuucuuuuccuuacaaccaaaauaaucuaaauuaagauuguggccaaguuuggauuaaaaccugccucccggcuccaagacccauguuuuucuaucaugcugacuggcagcaaagacgucuucccauggauuuuucagaacucuguucuuuaaaugugaccuuagaugcaccagacucaugccauccaaagguuggaggucgaagcuggcggggggguuuucccagacaacagccugucccgugcugcucccugccagccccaaaucaggaguccccccacccccgcaccaccguguuucuaguccugagagugaugggcugggggauggagccucugaaaauuccacgaagguacugcccaguuuuagcaaugaaagucccacgucacgggaaaccucugaguccuggacaaaucaagaugguaagucacccuagguaugacccuuacauuuucuaugcauaugcaagcaugucaccaggagcagagcacagagggacaacacagcuuuugcgcuuccagcuggcucccaucaagaaguuagaagggagccugcaaacacauuuccugcuaucaucucuccaccccagaaugacuuucccugguagagcugggggaggggaggcgggcagcaggccccccaggaggcccugggcaggaauauuaauacuccaacuucccagcacaagaggagggaggaggagcggccacggcgcaguccgguccugggggcccuggaaggugguugcugagcagcccgugggaggcacggauccgccagcucacggcggcaggggccgcccaaguccuaaugaaaacaccuagcuccuggcagggcgcagccgacacaucgcccugccuucucggccaccugggagaggaugggcgccgcacgcggauacccaaccugccggguugugcucgcagugacaucgcuuuucucccggcaagugcauccaucucgcugggucuggauagauaacacaaucucucugcccacaccccauuugcugggagacagccugggcuucuccauuuuuuaugggcucacuuagcuuggaggaaauccagaggucaaagccggcgcagacgcuccagucaccuugcccguccgggcgcgcagccauuccgaaacgggcucacccacggggcccuaaauuacggcgauuacacugcaauucgcagcgcgauauuacuuugauacacuaccugcugcagcuuggcccgggaggcgugcauuauuuaccagggaggcuguccguacugcgcaccagagcugacagcgcuccgcggggucccuccugucccuacagccccgccuucgcccgcggugcggggucuggaggcaguggggcgggggcagggggucacuggagcagccccgcucucucggagugaccguuuccugaacgcaauauagcccggagaggacccaguggcggaagcggcagcuggcgaugagguuggggguuaguaggugggaacaagugcugagcccgcagcuccuccuggcucuuaaggacacccagacccuccuuagccggccuauaagggcccuuguugcgcgcgcgcagggacccacacagggccugcccaggggugcaaggcuggucccuggccccuggccaacuguuaaaacggcuagcagccggcuaaccccaccggcaggcuccaggauuuagccuguggcggcugguggcggagauggagggaacucaggcuacccucuuccucgggcccuggaagcugcgugcgccucagcugaggccugauuucgccguggcugggggcuggggccggaguugggcccggcuucucuccggcucccccauuacgguuuggcaucagcaucuagauugcagguuacuucugcuuuuauccaaagcgguccuuaagggagauggaguucugauugaaauccagucaauuggcgccguggcucagagggcccagcgugagcacacuuguagggaaauugcccugggucugagaggaggggcaggggugggggagggaacaggacccgcaggccugcucuggagccugugaacgcgcugcugcgaggacuuuagcggaugcgcucaggucgguauccgcgggaguccuggagggaaauccgcucuccuucuccagcucccugggauugauggaaccagaaaccucaagcaagggauccccagaggucacugcguccagucuccagccucagacagugucuggguaguggaggaggggccgagucugugggaccgagcugucugcuuuggugggugaaggaggguggacuucuggggucuggguugagauguggauuaguuccaggacuaguuccuguuacucguaggcggggagaggucauggucccugcugaacacaucuggcuguguucaguccugaacugcccugggcuccucagcagugugcacaggggucuggccuccaaauuucuuguuaacagcccaucaggagcuggaggagcuggccuggccuucaagguguggagggguuccuggaaggaagcagaugggcacacggaggagaagaaugacaaauccaugcuuccccaaugcuggggagagaauauggugguggggaggaagcauggagaccagaagcauucccgggaaugcuucuggaaguaucccagaaaugucaagagcucauucugccagcucuuccggggccagcaaagaacauacauaucauuucuccauccacuuugggaccugccugagaugaacauauguuuuaaaaggaaucccaauugcugcaggagcagauggugcuacaggggcaggcaagggcaggagaaaggauacuggcuggcaguaggguaggaguccugggcucugccucgccccuuccucuuaccagccgugugagcuguguggcugcgggcaagucacuccccggcucugugcugccccauuuuccuugugaagaaugaguggguccccuguagcaugcaggaugagcugaggccucacuccccugcgguggagaggacagaacacucucuccaucagcagggaagacagauuuuccuauuuauuagccuguucagcuggcagacacagggacuguccucuaggccaugggguggggaagagggggacagagccccacaccagcccccgcuguguccauccucugccuguggcuguuugccugauugauuuguuugguggccucccuggcugggauugggucccuguguccuccugcacauuugccucuggucccucucuguguggucaggagggggagcucuagguguaggggcggaagagacuggaacaucuauccaucacggacugacucuugggcuugguaaggauccuaacaaccaccggguccaccugccaccuugugcuccgggccccuccccagaagcucccccugcagugggaggcucacugccucucgcugagccacucccagaaaguucacccuuuucuggaucccaagucgagucccuugugucaucucucauucauccuagcucuucuuguuggccuaggugugaacuccaugccuacaggaccacccuucagauauuucagggcagcgaucuuguucauccccuacuccaccuucuuggggcaaaaccugccuaguauccucccugcugcuucccaguccccucacacucuagcucugacaagaagugauugagcuuccagucagaugucagaggcccuggucuccagggagcuucuagucugggagauagucuuccuaggaccuaaagaaugaauaacaaaaucacacaggcauuugggacuguuggauuuccaacugguauggcugcuggucuggaaaccuccucagaggugaguggguuuagucgucuuccauguagagaagucuuccuguucucucugaaacagcuaugcucccccuccucagagacugugggacuacugggugcuccgauggcgcuggugccugcuccggagagaagugggagagaauacuuuccaguucuucccaccuccauccccauccauccugguguggguaccacagaaaccugagguccagggggaagcuuuccacagugggaccaccucagugucuucgguccccagggcaccuacuuuuucuccugacuuccagaagauguucccagaggggcuggucuacgcugcaagagugggcccgccacaucuaggccuccaccccgcccccagcucuuaauuuauuauuaacucuggaacugacuuugaaauuauggaaggccauguuguuucuuuccucugcaucucuuaugguccccaaggggaggcgagcugagagugccagauacacaaauaugcagcgaaaacccuguggauuuuugguucuagcaaggggaaggaaauuagcuguaauaagcugcugucgccucacuggaaagccuccagcacagacccucggaggggcuccugggcccccuuccucugcucuccccacuucccggcugcauggcugaagaucucugucuucagcuuccccugcaggggaguggccuccuccccacccaguccugugacaucacugauggagaugaucaauaucccgggccugugaggaggaggaggaggaggagacugcaggcacacagagaaguggucucuggccucuucccaagccauuagcuugaauggugguaggagaggcaggugggagucaauuuccauucuccuagaauuacuggaaggcagaggguuauuuggaaguuucugaaaggugugagguauucauuggcccucacacaaaaggaucaguaggcucuggucuuuccuuuuuccucuccugaggagagccaagggcuaaaacccuuaagugacuaccccacagcaacagcugcacuuaggcagaaaauagccugggcugugacuggagcccuggaaggaacuaguucuagcccuuugcuggcuaacuuggcccauccugaucuggcauugggcuucucucuggcuucuaaugcaaagaacauaacucaaucaaauggcagauaugauguuaagcauucauugaauugagugguuaaguucccccauaacuugcugugugaccucuggugagucaccuaaccucucugggcuucacauacuuuauauguaaaaggagagcaggagugagaugagugcaccauuucuaagacccaggaguaaucaugcugggacacauguuuuauaaccguggcccaaacgcucuuuccuucauguccaccagccaaaauguugggccucacuugccgguaaugcuauuacauggaagguuuuacggccaacaggacagucaugagcuuucacuacuaauaauuaucuuugugauuuaaaauuuuagcaauaagauggauucuuaccaauauuacuauguauuagucuguuuucacauugcuguaaagaacuaccugacacuaggcaguuaauaaagagaagagguuucauugacucacaguucagcgggcuguauaggaaacauggcugggaggccucaggaaggugcaugggaagcaagcaccucuuuacaugguggcaggagagaaagggcaaaggggaagugccacacacuuuuaaccaaccagaucucaugagccagcacuagggggaugguacuaaaccacuagaaaccacccucaugauccaaucaccucccaccaggccccaccuccaacacucgggaucacguuucaacaugagauuuggguggggacacagagccaaaccauaccauaccguauauuuuuacuuuuuaaaaaacuuccuaagauuuuucccuuggagagacaacaggcuguaagagugaagagugugagcccaggagucugucugccuggauuugaauccuggcucugccaccuaccagcuuuguuaucuugagggugucccuucacuucucugugccuccguguccucaucuauaaagugagaaaaauggcugggcguggcgguucaggccuguaaucccagcgcuuugagaggcugagacggguggaucaccugaagucaguucgagaccagcuuggccaacauagugaaaccccgucucuccuaaaaauacuguagucccagcuacgggaagcugaggcaggagaauugcuuaagcccaggagguggagguugcaaggagccgagauugcgccacugcacaccagccuggcugacagagauuccaucucaacaacaacaacgacaacaaaaagcagcggggaaaauaauacaacacaaagcugcuguggucugaagggcuuaaaacaguaccuggugcauaguuagugcaagcuuacugaguguugaguguuauuacugucaaugauaauaauagaaugccuuugaacccuu

SEQ ID NO: 1258 - RNA, 1044 nt, Homo Sapiens
aguccccaggaauuucuggcuccugccuucagauugugaacuuuccagguugguagaucagcuuagguagaacaguucucggugagggccagcuacauaccuggcuaagcgcugcccacugcagaaaagcucaucacccgggaccugaucuccaggacucagaagcacuuggaggaaggccuauucacuuagaagcaguuaccagugcugggcaguguccuccaagugccagaggagugcuguggagaaaagaaguccauggaagccaggagaugggcaagguguggccugggguuggagagagcucagagauuuugccucuucaaggugaaugcggcuucaaggggcuaucuuugugcuccugccccaccuggggcccauccuggucuggcuguucacucgugaucacaugucugguuggugugagggcccgaggaugcuguccuggugcccauucuacaaagucuuauugcuuguacagacagccaucuacucugucgugggcuaugccuccuaccugguguggaaggaccugggagggggcuugggguggccccuggcccugccucuuggccucuaugcuguucagcucaccaucagcuggacuguccugguucucuuuuucacaguccacaacccuggucuggcccugcugcaccugcugcugcuguaugggcugguggugagcacagcacugaucuggcaucccaucaacaaacuggcugcccuguuacugcugcccuaccuagccuggcucaccgugacuucagcccucaccuaccaccuguggagggacagccuuuguccagugcaccagccucagcccacggagaagagugacugaggcccuagggcaugggagaggagggacgcccaggguggggaggaagagucugcaagcagggcuguggaguuaggguucaccccaaugggaccacccuccuggguccccuggugccguuuuuccuuagaaaucagagaaaugggaaagggggggaaacugauuuuacacuuaaauaauaaaauccuauuaguaacucugaa

SEQ ID NO: 1259 - RNA, 161 nt, Homo Sapiens
gccaugcacagcucaggaauacagguuauuggggcuugaagcugagucaucugccccucaccugacuucacccaccccuaacugccaugacaacgggagccggucaccccagagucaccuggauacuucacaacuuuacugguggcccaggacuugcaggg

SEQ ID NO: 1260 - RNA, 5078 nt, Homo Sapiens
uaugaaaugguucaagcuggcuuauucaggucugcugagaucucuacugguuugcuuuucagaucccucgugguucgagaacagaauggcguuaaaucacacugcccugccucaggacgagcgccugccccauuaccuucgagauggggauccuuuugcuuccaaacuuucuugggaagcggauuuaguggcuggcuuuuaccuaacaauaauugggauucuguccacauuuggaaauggauauguccuuuacaugucuucuagacgaaagaagaagcugagacccgcugaaauaaugacuaucaauuuagcagucugugaucuggggauuucagaguugaaggcaguugagaggugaauguaggaagaggaaagaggugcccugcugaugauauauguaaucaugacuuagugacauaucacaagcauaggaagcuucugguucagugguccucaaaugcaacucacaaaauaucaucuggggaaguucugaauuaagucguugagaguguuaccugggcaucaggauauuuaaaaugagaaucuacaguuguaggcaagccguucaccaucaucucuugcuuuugucaccgcuggguguuuggcuggaucggcugccgcugguauggaugggcuggauuuuucuuuggcuguggaagccuuaucaccaugacugcugucagccuggaucgauauuugaaaaucugcuauuuaucuuauguucugacuucuggagcaacacagaaccaaucuacuaaucuacucccuccuguacuugacagccuuucaccauacuggaaucgagccaccaagccccuuccacaaguucuuaggaagccagauaagacuagcaacacaaaagcuguuagcaggaagggcguuuuaaagacacaagccauguuuugugcuuccucaccucccagaaggauuuucccuggaugauccacuaacacacccuuuccgagauguuuucucaagggccuccauugucuucagcauccucucaucucuuuccugucccuuuucccagcuguugucacuucucccucccaaagcucccagaugccuagagaaaaccuuccaauuguguucuccuggagaaaggcccaagcucuggaacuuuuuuccguuuacuccacucucccucaggcuucaguuaucugcccagggguuuggcugaaaagaaagcacgccuacaucugccuggcagccaucugggccuaugcuuccuucuggaccaccaugcccuugguaggucugggggacuacguaccugagcccuucggaaccucgugcacccuggacugguggcuggcccaggccucgguagggggccagguuuucauccugaacauccucuucuucugccucuugcucccaacggcugugaucguguucuccuacguaaagaucauugccaagguuaaguccucuuccaaagaaguagcucauuucgacagucggauccauagcagccaugugcuggaaaugaaacugacaaagguagcgauguugauuugugcuggauuccugauugccuggauuccuuaugcaguggugucuguguggucagcuuuuggaaggccagacuccauucccauacagcucucuguggugccaacccuacuugcaaaaucugcagcgauguacaaucccaucauuuaccaaguuauugauuacaaauuugccuguugccaaacuggugguuugaaagcaaccaagaagaagucucuggaaggcuucaggcugcacaccguaaccacagucaggaagucuucugcugugcuggaaauucaugaagagguaugaagauggauacagcaucacuauggacacucguauucacuuauuugccucuucacugcuguaaacauuugauuguggccacaugggaauaacaaauguucugguugugaagagugcaucugaagugcuuacacggcgucuggcauaugcagagaaauuagcuuacaaauguuauuuuucugacuucucgccuccacuccacuuacccugucaggaaaaaauaauucacaaggaauaucaaaacaaugaugcacccuaggaguauccaaguaucuuaacugaguuaucucauucugguauaguggcagaguuauaacuaaagagugccagaaacccacgcuuuaaacauccugcagugcacaccucggucucgucaguaaggacuucacuuucuucugaacuggggcuugugaaagcuggccugaaaagccugauucaaggagaucaggcugugucucugacuggagcagcuacacuccccaucuguaauuugauuuguucuauugcagaugauguacugggcagaggugaguguggauuggugaaaaucuguuuuuaugacuggcaaagcagugcaggggggucuuucacugauaagaagcaucaucaguaggguuugucccugaugccuuuacaacagcaucugagcaccucucaaguuuuuccaggccagcuccaguuucagugaggagagugugggcuuucuauuccccaaauauucuuacuacaguuaauauguagguuacugccccagcccaacugcagguucccagaugugaguuccauguaggcagaaacuguccaguucuugaaauugaauuacuuccuuguguauguguuuuuuuccuacuuaaagcuccucgggaugcuuccucucaaaagucuuugaagaauaagagguuaagcuaagacaaccugaaucaauuuuuuuuuuuuugucaaaugcgauugaaauuauccccauaauucaauaaaauagcuuuuucccuucuuucuuuuuacuuuguuggaaacuaugcaacagaaacaaaguaagaagacucuaccuuaauuuuaaagguaacucuuacauaaagaagaaagucauuaugccaggccagggggagaguggaaaggggaaauuuagagaauagaaacaaacuuaagcaucuuguaaauuuugagugaauuguaaacacauaaugaaugaaugagaagggccagccaggagucugugaaaugguccaguugggaaaugccuaaugcauaaacacaaaucuuggugacagguagguuaguuaucugugaacuuucuaaagauuaaauaaacaauaauaggauuuuguuaaugugccaaagugaguuuaaaccaugaaagacacgaugcaaauaugcaaguaccuuuaauugggcauaauaaaaaguagugagguaugguuaaaauaacauuuagaacaagagagaaguuagggagaauuuuugucuaaaaagccaaaaagugauaguugauuggugauuuuguuguuaucaggagagagaauuuucuuaauguaauaaguuagguacuuuggcaagugaaauggguucuaggccaauugcaaguccuuaggauucccuggcagcuagaaaccuuggcacucccaaaagacagcuucaguuaaaaugacagaugaacaugagucuucaagucaaaacuacuguuguaccacguccauugaauguuuggugauucaagucucuguuauucaagaacugauucuguuuuuccuccugucaaaaccuugguugauuuugacuguaguagcacaucuggcaggaauaugacagaaaaaaauuaaguuaaaaauauaauuucuauuccccuauuuuuucuguaaaaggcuuuauggggaagaagggaagaagguugacaugaguagagaugauacuugccucuggaugacccaguuggguucuccuuugacugccauucaccacaguugaccucauuaggcuccgaaguaugagaagagcuucauugccaaguuagugaaagaagcagaugauuuacuuuugcucgagugggucuguagaccucgggagguuagccauuucucuuagaguuugguguauguauuaagauacagcauguauguagguauauauaauacauauauguguguauacauauauauauauuucugguuuguuuaauaucuuuuaaaaaauuuuaauggaauuuuuugaacauguacaaaagagaaagaauccuacgaugaacucccauguauccaucauccagccucaauagugaucaacccauagcauauugugguucauguugacacucauccaccucuuuccuuccccaucucuccccauuauuuugagacgaaugagauccugggauuucgugaaaauauuaugaauaucuuauuugugagaacaagauuucccaaagcaugauccccagaaaccuaguccugcaaaacuacugcaaaaauaaaguguucuaaucuccaaaggcaggaacaaaucugcuagucccaauaaucuggaugcagacagucauaguaaugaugaugacugugguaagaaauaugaaccuauauucugaggccaagaaaccucuuaccuguucaccagggcuucagaaaugaauggcaaacuccaauauauuuuuugaaaugcagaaaauaauuuagaguauuauuuguauuuggcuuuuaaacuugagaaaauacacagccaaugccaacugaaguguuaucgaaguuuaaucaugaguauguaacauauaucagcuacucccucuucaaucuucacagauuuuuguaaaauagugacccaagauggaaaggauauucuaagcaaugggaaggcaaagagucgcuuaagcuuuucauucauugugauagcaacugaacuucuuaauguauuuauuguuauaaaaaugugcuugaaaccaccaauuauuuuuuccuguagaugguuagaacuuuuaauauugucugggaaacuucuagaagcauaauuugucaagucaaccugcauacagcauuuguaaguacucucuaugagaacacucagaaaauguuacaguuucugacucauucucucuagcccaguuguguguuaaacugaaggacacacuugacuauugcacuaggaaaaauggguuagguucuuuuuaucucugucaguuucccuuuauccacacauuuaaaauaauuucucucuuuucuuuuuaagucacagcuguguuauucaagugcacuuuuuuuuuucaauaaagaaaauauacugcauuggca

SEQ ID NO: 1261 - RNA, 86 nt, Homo Sapiens
ugcuucccgaggccacaugcuucuuuauauccccauauggauuacuuugcuauggaauguaaggaagugugugguuucggcaagug

SEQ ID NO: 1262 - RNA, 828 nt, Homo Sapiens
ugaauuugaagcccugacaaagagaaggcaaaaucaguuugugucccugaguugcuaaguggagaagaaacguccaccaaccaggaaacaccugccuccaacuguuaauaggucugugaaaugugcuuuguuucuggucagcauggacacccgcuuuaauaguggcuucagaugaggcaccuugugacagaggagcucuuccccugcagcaaccuugaagauguuguggaagacaauagccauucuuacuucacucugaggaucacgauggcgugcaagggugugccaagcacauugcuaucuuuggccauucucucucacauuaguacaccuggaugugaauggcacguuaucuauguaagcagugauggucucuaucuggugguagaaaugacagaauuacacacaaucaggacagcugagauuccauuuacuagcucaguaaucagagaauauguaugacaucccagcaaaaaauguugaacauguucagauuucaucauaucagcaccacaguaucagucuuacugggaggugcucgcauucaguuccuggcuacugaagaaauuuugcaggaguuccagauaacuuacuugucccauaauaaugaaaacuauuacaauuaugcuaaagaagaauacuuaauaacacaguaaaaauguuuaugaugucuuuuaauuucuaaagcauguuauaaaaguauuacaguaugaucucauauuuguaaguaaaauauauauuaauucauuuagcaaauaaauauuaagccccuacuaugcacauaccaauauagauauugguauuuguguggguguguguuacagcaga

SEQ ID NO: 1263 - RNA, 96 nt, Homo Sapiens
cuccuaugcacccucuuuccauaggugaugagucacagggcucagggaaugugucugcaccugugacucaucaccaguggaaagcccaucccauau

SEQ ID NO: 1264 - RNA, 7843 nt, Homo Sapiens
cugcucguggaagggaggaggaggaauguggaagguggcggcgcgcgagcugacaggcgguuccucgggcgggcugcggcgacggcccgagcgcuucuccuucgccgagguugcgcgcccccuccucgccgugccccgggcccgcgcgggaucgugcgucgucccgccgcgucccugaagggaaggaagcgaggcgcgaggccgucgauucgcucgcggcuccaucgcggccuggccggggggcggugucugcugcgccagguucgcuggccgcacgucuucagguccuccuguuccugggaggcgggcgcggcaggacugggagguggcggcagcgggcgaggacucgccgaggacggggcuccggcccgggauaaccaacucuccuucucucuucuuuggugcuuccccaggcggcggcggcggcgcccgggagccggagccuucgcggcguccacgucccucccccgcugcaccccgccccggcgcgagaggagagcgcgagagccccagccgcgggcgggcgggcggcgaagauggcagaggcaccggcuuccccggccccgcucucuccgcucgaaguggagcuggacccggaguucgagccccagagccguccgcgauccuguacguggccccugcaaaggccggagcuccaagcgagcccugccaagcccucgggggagacggccgccgacuccaugauccccgaggaggaggacgaugaagacgacgaggacggcgggggacgggccggcucggccauggcgaucggcggcggcggcgggagcggcacgcugggcuccgggcugcuccuugaggacucggcccgggugcuggcacccggagggcaagaccccgggucugggccagccaccgcggcgggcgggcugagcggggguacacaggcgcugcugcagccucagcaaccgcugccaccgccgcagccgggggcggcugggggcuccgggcagccgaggaaauguucgucgcggcggaacgccuggggaaaccuguccuacgcggaccugaucacccgcgccaucgagagcuccccggacaaacggcucacucugucccagaucuacgaguggauggugcguugcgugcccuacuucaaggauaagggcgacagcaacagcucugccggcuggaaggaugucucugaagaaaccaaugccuucuucagauccuuaugggaaauuuaggggacuuuuggauuacacaguguugccuuuugcugauucuaagauagagccuuccaauugaguggacagucuccacaagguaaacaugguuuggaagggcugaagcggacguaggguacaaaauuuaagaaauuaccaguuacuucugacuggcacggcaccucugaaauacuuuuuuaaaguuugaaauccuuuccuggaaggggccgcccuggaaccuuuuggcuuaaaguauaugaugcucggaaaacaaacuccauccggcacaaccugucacugcauagucgauucaugcggguccagaaugagggaacuggcaagagcucuugguggaucaucaacccugauggggggaagagcggaaaagccccccggcggcgggcugucuccauggacaauagcaacaaguauaccaagagccguggccgcgcagccaagaagaaggcagcccugcagacagcccccgaaucagcugacgacagucccucccagcucuccaaguggccuggcagccccacgucacgcagcagugaugagcuggaugcguggacggacuuccguucacgcaccaauucuaacgccagcacagucaguggccgccugucgcccaucauggcaagcacagaguuggaugaaguccaggacgaugaugcgccucucucgcccaugcucuacagcagcucagccagccugucaccuucaguaagcaagccgugcacgguggaacugccacggcugacugauauggcaggcaccaugaaucugaaugaugggcugacugaaaaccucauggacgaccugcuggauaacaucacgcucccgccaucccagccaucgcccacugggggacucaugcagcggagcucuagcuucccguauaccaccaagggcucgggccugggcuccccaaccagcuccuuuaacagcacgguguucggaccuucaucucugaacucccuacgccagucucccaugcagaccauccaagagaacaagccagcuaccuucucuuccaugucacacuaugguaaccagacacuccaggaccugcucacuucggacucacuuagccacagcgaugucaugaugacacagucggaccccuugaugucucaggccagcaccgcugugucugcccagaauucccgccggaacgugaugcuucgcaaugauccgaugauguccuuugcugcccagccuaaccagggaaguuuggucaaucagaacuugcuccaccaccagcaccaaacccagggcgcucuugguggcagccgugccuugucgaauucugucagcaacaugggcuugagugaguccagcagccuugggucagccaaacaccagcagcagucuccugucagccagucuaugcaaacccucucggacucucucucaggcuccuccuuguacucaacuagugcaaaccugcccgucaugggccaugagaaguuccccagcgacuuggaccuggacauguucaaugggagcuuggaaugugacauggaguccauuauccguagugaacucauggaugcugauggguuggauuuuaacuuugauucccucaucuccacacagaauguuguugguuugaacguggggaacuucacuggugcuaagcaggccucaucucagagcugggugccaggcugaaggaucacugaggaaggggaagugggcaaagcagacccucaaacugacacaagaccuacagagaaaacccuuugccaaaucugcucucagcaaguggacagugauaccguuuacagcuuaacaccuuugugaaucccacgccauuuuccuaacccagcagagacuguuaauggccccuuacccugggugaagcacuuacccuuggaacagaacucuaaaaaguaugcaaaaucuuccuuguacaggguggugagccgccugccaguggaggacagcaccccucagcaccacccacccucauucagagcacaccgugagcccccgucggccauucugugguguuuuaauauugcgaugguuuaugggacguuuuaaguguuguucuuguguuuguuuuccuuugacuuucugaguuuuucacaugcauuaacuugcgguauuuuucuguuaaaauguuaaccguccuuccccuagcaaauuuaaaaacagaaagaaaauguuguaccaguuaccauuccggguucgagcaucacaagcuuuugagcgcauggaacuccauaaacuaacaaauuacauaaacuaaagggggauuuucuuucuucuuuuguuugguagaaaauuauccuuuucuaaaaacugaacaauggcacaauuguuugcuaugugcacccguccaggacagaaccgugcauaggcaaaaggaguggagcacagcguccggcccaguguguuuccgguucugagucagggugaucuguggacgggaccccagcaccaagucuacgggugccagaucaguagggccugugauuuccugucaguguccucagcuaaugugaacaguguuggucugcugguuagaaacuagaauauugauauuuucaggaaagaaaucagcucagcucuccacucauugccaaaugucacuaaaggguuuaguuuuaaggagaaagaaaaggaaaaaaaaaaaaaacaaaaaaguccuguuuugcuuugcagaacaaaugaacuuacaggugagcauuaagcuugcagugagaaaugugcgaagaguaaaaacccaagucaaugcugaggcaguucuaacuucacuguuuuccuaaauacacauccuugauuauuuucagccuugcuauauaaucugaucugcuagaaguguaugagugagaggcaauagcauacaaacugauuuuuuaaauauaagcuuagguuguaauuguacaagugacucaauggaaguacaaaauagggcaguuuuaacuuuuuuuucugcuucuauggauuucauuuuguuguguuuucaaaaaguuauggugcuguauaggugcuuucuguuuaaccuggaaagugugauuauauucguuaccuucuuugguagacggaauaguugggaccaccuuugguacauaagaaauugguauaacgaugcucugauuagcacaguauaugcauacuucuccaaagugauauaugaagacucuuuucuuugcauaaaaagcauuaggcauauaaauguauaaauauauuuuaucauguacaguacaaaaauggaaccuuaugcaugggccuuaggaauacaggcuaguauuucagcacagacuucccugcuugaguucuugcugaugcuugcaccgugacagugggcaccaacacagacgugccacccaacccccugcacacaccaccggccaccaggggcccccuugugcgccuuggcuuuauaacuccucugggggugauauugguggugaucacagcuccuagcauaaugagaguuccauuugguauugucacacgucuccugccucgcuuggguugccauguuugagcgauggcccuguugauuucacccugccuuuuacugaaucuguaaauuguugugcaauugugguuauaguagacuguagcacauugccuuuucuaaacugcuacauguuuauaaucuucauuuuuaaaguauguguaauuuuuuuaaguauguauucuauucauauggucugcuugucagugagccagacuugcuuacuauauuccuuuauaauaaugcuagccacuuccuggauucuuuaguaaugugcuguaugcaagaacuuuccaguagcagugaaggaggguugccucuccaagcuuccuaagggaugcugcccuguguggggaugcauugcagaggcacuaguagcaugggggcuagaguggggagcgagauguaaaaggguggggggauaggagaauuccagagugcuuccagcauuaggguccugagaacuucugaguucagagaaacaugcaaagugacuaacaaaauagcuacuuaccuuugcaguuuuacagacccugggagcugcuuugggagugagaaaggcaacccuccaauguguuucaacuuuaaaauguugaauucuuuucagacaugguaucucauuuauucuccuuuucuagcguuuguugaauuucaggcagaaugucuuacagaauguccuagaaccagauuaucauuuaaucugaaacagcugaggaagggacagagaagguacaagggcaaggcagcacaaaacagaucaggagaaugaagagggaaugcuuugguuuuuuguuuuguuuuguuuuuucuuuuucaaguaacuaaaacagcaucuacauguagaguguuguggagagcugagaccaggguaaagucaagugcagcaucaguacugcgagacccaccagccccuggagagggucagccgagaaucugguagugaagccugucuagggucccggcacccucacccucagccaccugcagagaggccagggccccagagacuagccugguucugaagugggcaggggugcugccagagcccucugccccuuauguugagacccugcuuucaggacaggccagccguuggccaccaugucacauucugagugagugucacaggucccuaacaauaauuuucugaucuggagcauaucagcagaaugcuuagccucaaggggccuggcagcuguaauguuugauuuaugaugagaacuauccgaggccacccuuggccucuaaauaagcugcucuagggagccgccuacuuuuugaugagaaauuagaagaguaccuaauguugaaaacaugacaugcgcucuugggaucugcuguucucuccagggcuccagaaccugauaccuguuaccaaagcuaggaaagagcuuuaucacaagccuucacuguccuggcaugagaacuggcugccaggcucaguguaccccauuaacugugaaugaaucugagcuugguuuccuuuauugcuuccucugcaauaugauugcugaaacacauuuuaaaaauucagaagcuugucacuccuguuaaugggaggaucagucacacauguguaguacaaggcggacuuuguguuuguuuuugguguuaauuuuuagcauuguguguguugcuuccccacccugaggagaggacaccauggcuuacuacucaggacaaguaugccccgcucagggugugauuucagguggcuuccaaacuuguacgcaguuuaaagaugguggggacagacuuugccucuaccuagugaaccccacuuaaagaauaaggagcauuugaaucucuuggaaaaggccaugaagaauaaagcagucaaaaagaaguccuccauguuggugccaaggacuugcgaggggaaauaaaaauguuauccagccugaccaacauggagaaaccccgucuccauuaaaaauacaaaauuagccuggcaugguggcgcaugccuguaaucccagcuacucuggaggcugaggcaggagaaucgcuugaacccaggaggcggaggucgcagugagccgagaucaugccagugcacuccagccuggguaacaagagugaaacuccgugucaaaaaaaaaaaaaaaauguuacucauccucucugaaagcaaaaaggaaacccuaacagcucugaacucugguuuuauuuuucuugcuguauuugggugaacauuguaugauuaggcauaauguuaaaaaaaaaaauuuuuuuuugguagaaaugcaaucaccaguaaagagguacgaaaaagcuagccucucucagagaccggggaggcagaguacuacuagaggaagugaaguucugauggaaucaugccugucaaaugaggucuugaagcggaugcccaaauaaaagaguauauuuuaucuaaaucuuaaguggguaacauuuuaugcaguuuaaaugaauggaauauuuuccucuuguuuaguuguaucuguuuguauuuuucuuugaugaaugauuggucaugaggccucuugccacacuccagaaauacgugugcggcugcuuuuaagaacuaugugucuggucacuuauuucucuaaaauuaucucauugccuggcaaucagucuucucuuguauacuuguccuagcacauuauguacaugggaaauguaaacaaaugugaaggaggaccagaaaaauuaguuaauauuuaaaaaaauguauugugcauuuuggcuucacauguuuaacuuuuuuuaagaaaaaaguugcaugaauggaaaaaaaaaucuguauacaguaucuguaaaaacuaucuuaucuguuucaauuccuugcucauaucccauauaaucuagaacuaaauaugguguguggccauauuuaaacaccugagagucaagcaguugagacuuugauuugaagcaccucauccuucuuucaaugcgaacacuaucauauggcauucuuacugaggauuuugucuaaccauauguugccaugaauuaacucugccgccuuucuuaaggaucaaaaccaguuugauuugggaaucuuccccuuuccaaaugaaauagagaugcaguacuuaacuuuccuugguguuuguagauauugccuuguguauuccacuuaaaaccguaaucuaguuuguaaaagagauggugacgcauguaaauaaagcaucagugacacucuaucuua

SEQ ID NO: 1265 - RNA, 2289 nt, Homo Sapiens
cuuucggaguggaguuuccuagcuggugccuguccucucuugagccuuuguuucuugagugagcacucacuggggcuguggcuccaugaacuggauuucaggaaaccagccaaggcauucucucucucucuccauuccuagaaaggcagaaagccugggaauggguucggcaggaagaucucuguaccucaaucuccauugcuuucagcaccacuggcuuucuccccagcucaagugcaaaaccugccaucguugcuaccuggggugccucagacucacccaagucccccaggccagaggacaugcucucaagccuuguuucagaaagagggacccaaaggcuguuagggaagagaaccaggguccucaaacccaggguuuucucacccacugccucugcucuggcuguggccugccagaccucuccucugauuuucgcuuuccuuccugccagugccuuuguuuauccgaggcgccaagaucccacugugaagucugaaaggaagaccagugguucucgcuuuuccucuagaugcugugucucccaaugucaucuucuuuccucucaaagacaauuggacguuguuacagauuuucuuggaaugaguaaauaccuagcagugggauugcuggaucauaugaaaaugccagacuauauuucaucagcaacaucggagaguuccaguugcucuacacccucacuagcacuuaauauuguugaucgcugccuggauucacagaaggacaaauuacaaugcauuuugaaagacucgucuacagucaacuaaaauaccaguuaucacagacuucacuggccuuaaugaggaggcugagagggauuuaauuacugggacaugcaacgcuuacaccaaacucuguucgauucacgacuuggaaaagcaaauguggauacagaugaguguggacauggcuucaguaggaaaugucgaguuuguucaucacucugaaguuucuucagcugcaacggaaacugcacccucccucccgacuuguugguuaucuugcugugcucccaagaagguauuuucugcugaccugauagaucagguaacaccccuagagugagccaagagaagaugagaccuuugucauuuugauugaaaagauguuuaccuguugguccccagccucacucuucugaaccucagauccacugaguguguauccagagguaaguaugugguaaguaugcuugucauuuacauuaucugucagcaugaguauugguuuccuagaaaccuaauauugaaaacacuuagcauugcuaaaagcauuaaaugaaauaaagacucaauauagcugcacuaaucugugcuuucuaaauuuacugauggacgugaagaaaguagguuggcauggaguuuauacaauuuauggaucacacugaucugaauucagacagugugugcucagauaaaaauauuguuuccucccaugagguuuccaauuuugcagagaagaauaccucuguuuagcucauuacuuaacacaauggguagcuggguggccuugcauucuggaagugaaaugacacaagaaugucuccacugcauucuccagagguaaagauucucuggcacaaaaucacaaccaaggugggguuccaaaacuauagaacaaauggcagcagccaugcagccagccuugguucgggugggcuguaaaagcagagguuguccucguguuaucagcacugacuuccuguuguggccacacugacagagaugagauggcagaaagcaggaaagagaccagagcugcaauugacagauggcuggccaaaguugaagggucagagacuacaccaaagacuucucagaaaauacuugccuaggaggcucucacuuggaaagauauucaggguuguuaaacauauccuguuauuaggaaaacgagaguuuuaucuuucucuuacucagaaagaaaaaacaaaaagaaaauuagugcucuuaagaaaagcuauuuuaauguuauccauuauaaaauuagaaaaccuugaaaggcaaauguuucuucugaccauuuacacugagcuucuuucauuaucucauaugcaaccuuguggauugaagguggagaguccuuaggauuacccaggaacaucccugucugcucccccugcuaggcaggaggagauuugaaaccacaugugucuacuucauuucugucacggguaggacagugucauauacuuuguagguaacucaaagauauuauagguaacucauagauauugauugaauuaauguuuaauaaaaugagaacacc

SEQ ID NO: 1266 - RNA, 4093 nt, Homo Sapiens
gggcuggggcuccgcuggggaaccggccgagcggcgcgcgcggagguguccggcggccaggaggauggccaaggucccggagcuggaagacaccuuccugcaggcgcagccugcgccccaacuguccccggggauccaggaagacugcugugugcagcuccugggcaagggcuugcuagucuauccggaagaaacaguguaccuggcggccgaagggcagcccgggggcgagcagggcggcggggagaaaggcgaagacccggagcugccgggggcagugaaaucagaaaugcacuuaaacaaugguaacuuuuccucugaagaagaggacgccgacaaccacgacagcaaaaccaaagcagcggaucaauaccugucucagaagaaaaccaucacgcagauugugaaggauaaaaagaagcagacacagcucacgcugcaguggcuugaagagaauuacauuguaugugaaggaguuugcuuaccacggugcauucuuuaugcacacuacuuagauuucuguaggaaagagaaauuagagccagccugugcggccaccuuuggaaagacaauucgccagaaguuuccccuccuaacaacaaggcggcuuggaacaagaggccauucaaaaacauggggugacuucgggcaauuuauuugaauccaagagccauagaugugcccaacagcaaggcauuaacaauuugaauuuuuuucugcugugcugauaugccauuugauauuugugacgugacuuuuuugauauguuuauaucauagagaaaaauuaauuuuccauauuuaaacuacauaugguaaaaauauagcaaaauguaguuuguauaucuuguaaauaguaauuuuuuugacauaauuauucuuagcuagguaucauuacuaugggauuggcaucaaagagagcagugcauauuaccacuccguuuauucuggaaagggcuugacaagguuuucuggaagcaagcuaaagaaugaggguggcuucacucguaaauauucgcuuagcucaaaaacuggaacacuucuuccagaauuccccagcgcucaacaccuuguauaccaaggaugcauuucuaaggacaagguugauacgcucauaaugauguacaaaacucacugccaguguauccuggacaaugcaauuaauggaaacuuugaagagauccagcauuuuuuauuacacuuuuggcaaggaaugccugaccaucuccuuccccugcucgaaaauccuguuaucauugauauuuucuguguuugugacucaauucuuuauaagguucuuacagauguacucauuccugcaacaaugcaagaaaugccugaaagguauguucaguuaauaaaacaugacuuauuagcagacauaagaaauuuugcuaaaaauugggaacaguggguuguuucauccuuggaaaacuugccagaagcucuaacugacaagaaaauaccuauugugcgaagauuuguaucuucucugaaacgacaaacaucuuucuuacaucuugcccagauugccagaccagcucucuuugaccagcaugucguuaauucuauggugucugauauugaaaggguugauuugaacagcauuggcucucaagcccuucuuaccauuucaggcagcacagacacugaaucugguaucuacacugaacaugacucuaucacuguguuccaagaacugaaggaucuccuuaagaagaaugccacuguggaggcuuuuauugaaugguuggauacugugguagaacagagaguuauuaagaccagcaaacaaaauggaaggucauuaaagaagagagcucaagacuuucuguuaaaguggaguuuuuuuggugcucgaguaaugcauaaucucaccuugaacaaugcauccaguuuugguaacauacgugcauuauaaaacuguucuuacaugaauuauauaauuuguuccucagucacaguuccugucaauuuuuaaacauguuacaucaucacuucuuaaacuguaucugaauauggagcuaugagaaaaugguauuuaugagccuggguuuuggagucagaccauaagcaggauuaaauccuaacaaugauugucucuggcuaugggccaaucugcucauugaagaaggggaagaauauucucuucgaaggguuguauagguacuuuggugagaugauguauauaaaaacaaauugccuguucuuuucauuugauucgaaugcuucucgaugaauacauucuccuggccauggagacccaguuuaauaaugacaaagagcaggaguuacagaauuuauuggacaaguauaugaagaauucagaugcgaguaaagcugcuuucacugcuucuccgaguucaugcuuucuggccaaccguaauaaagggagcaugguuuccagcgacgcugugaagaaugaaagccacguggagacaaccuaucucccucugccauccagucaaccuggaggccuaggcccugcucugcaccaguucccugcugggaacacagacaacaugccgcucacaggucaaauggagcuuucacagauugcuggucaucugaugacaccacccauuucuccagccauggcaagccgaggaagugucauuaaccaaggaccaauggcagggaggcccccaagugugggcccaguacugucagcuccaucacacugcuccacauacccagagcccauuuaucccacucucccucaagccaaucaugacuuuuauagcaccagcucuaacuaccagacuguguuuagggcacagccccacuccacaucaggacucuauccucaucacaccgagcauggucgaugcauggcuuggacugaacagcagcuuucaagagacuucuucaguggcagcugugcggggucuccauauaacucccggccaccgucuagcuauggcccaucccugcaagcccaggauucacacaauaugcaguuuuuaaauacaggaagcuucaauuucuugagcaacacaggagcugccagcugccaaggagcaacacugccuccuaauucaccaaauggauacuauggaagcaacauaaacuacccagagucucacaggcucggaucaauggugaaucagcacguuucugucaucagcagcauucguucacugccccccuacagugacauccacgauccacuuaacauuuuagaugacagugguagaaaacagaccagcucguuuuacacagacacaucaucuccaguugcaugucgaacuccaguccuagcuuccaguuugcaaaccccaauuccuucuuccucaucccaauguauguauggaacuuccaaccaguauccagcucaagaaacccuggacucccauggaacaagcaguagagaaaugguguccucuuuaccaccuaucaacacuguguucaugggaacagcagcuggaggcacuuaaaccaccaaugugggagggggugcuaaaacuuuaaaaaaaaucucuacugugcaaauaucauuauucacucagacuuccauaagaguaaauaaaaaugaauaugcaguggcugacauuguuuuaaagucacugguacuauggacaacuccauagugaauggagauacuugcagagcuugucaugcacacuaagaguuuaaaaugugagcucauuauuaaucauaguuucaaaauuaucaaauaaaaccagugaagaucugaagaugcaaacauuucaacuaugaagauuuacauuucacuuucuaauuuauuaaacaucugugugccuuuuuaucuuugguuucuuuuaaaaaguauauuuaaugccuuuacaauaccuuuaauuuauuaggaucucagaaucauuguuuacuaucccuuauuugacaaaaagucaaauguguauguucuaccuccaacggaaauguuuacaaggucaagacuuaauucaauucagacaagaccaaaguugcuugacuucaauuccugugcauuagugugaugauuucugucacauagcagcauuccgauucuauguaacugaauggagaugauaagugcuuuccccucuuuauuuaaaaaagauuaaaaggaauaaaagaaauaauguauggaaaua

SEQ ID NO: 1267 - RNA, 2020 nt, Homo Sapiens
cuacugcaacuguucccauaaacugggugacagagucagaaaacuccccagcuaaacacccguaagacuucauacaacacaauacucuauacugugaugaucacagcugccaaggcuaccuaaaagaagacaguuaucucauauuuggcugccagcuuuuuaucuuucucucgaccacuuaaaacuucagacuuccuguccugcugguaucauggagaaaguccaauaccucacucgcucagcuauaagaagagccucaaccauugaaaugccucaacaagcacgucaaaagcuacagaaucuauuuaucaauuucugucucaucuuaauaugucucuugcugaucuguaucaucgugaugcuucucugaaguucugcuacaaccucuagaucugcagcuugccacaucagcuuaaaaucugucaucccaugcagacaggaaaacaauauuguauaacagaccacuuccugaguagaagaguuucuuugugaaaaggucaagauuaagacuaaaacuuauuguuaccauauguauucaucuguuggaucuuguaaacaugaaaagggcuuuauuuucaaaaauuaacuucaaaauaaguguauaaaaugcaacuguugauuuccucaacauggcucacaaauuucuaucccaaaucuuuucugaagaugaagaguuuaguuuuaaaacugcacugccaacaaguucacuucauauauaaagcauuauuuuuacucuuuugaggugaauauaauuuauauuacaauguaaaagcuucuuuaauacuaaguauuuuucaggucuucaccaaguaucaaaguaauaacacaaaugaagugucauuauucaaaauaguccacugacuccucacaucuguuaucuuauuauaaagaacuauuuguaguaacuaucagaaucuacauucuaaaacagaaauuguauuuuuucuaugccacauuaacaucuuuuaaaguugaugagaaucaaguauggaaaaguaaggccauacucuuacauaauaaaauuccuuuuaaguaauuuuuucaaagaaucacagaauucuaguacauguagguaaaucauaaaucuguucuaagacauaugaucaacagaugagaacuggugguuaauaugugacagugagauuagucauaucacuaauauacuaacaacagaaucuaaucuucauuuaaggcacuguagugaauuaucugagcuagaguuaccuagcuuaccauacuauaucuuuggaaucaugaaaccuuaagacuucagaaugauuuugcagguugucuuccauuccagccuaacauccaaugcaggcaaggaaaauaaaagauuuccagugacagaaaaauauauuaucucaaguauuuuuuaaaaauauaugaauucucucuccaaauauuaacuaauuauuagauuauauuuugaaaugaacuuguuggcccaucuauuacaucuacagcugacccuugaacauggggguuaggggagcugacaauucguggguccgcaaaaucuuaacuaccuaauagccuacuauugaccauaaaccuuacugauaacauaaacaguaaauuaacacauauuuugcguguuauauguauuauacacuauauuccuacaauaaaguaagcuagagaaaauguuauuuagaaaaucauaagaaagagaaaauauauuuacuauucauuaaauggaagugggucaacauaaaagucuucauucucauugucuucacauugaguaggcagaggaggagaaagauggggaggaagagaaggcguuggucuugcagucuugucuuagggguguggggagugggggaaagaauauucauguauaaguggacccuugcaauucaagcccuuguuguucaagggucaacuguaauaggauauagcuauuuuucuuccucuaucaaccaaaugguaagcaucuauuuugcaguccacucuacugagcuaaauuauagauccagcuaugcuauuuauaauuauuuucuugaugaauaaauuu

SEQ ID NO: 1268 - RNA, 2895 nt, Homo Sapiens
cggagacuuguccgucacgugcggccgcccggccucucggccuugccgcgcgccuggcgggguugggggggcggggaccaagaucugcugcgccugcguugugggcguucucggggagcugcugccguagcugccgccgccgcuaccaccgcguucggguguagaauuuggaaucccugcgccgcguuaacaaugaagcagaguucgaacgugccggcuuuccucagcaagcuguggacgcuuguggaggaaacccacacuaacgaguucaucaccuggagccagaauggccaaaguuuucuggucuuggaugagcaacgauuugcaaaagaaauucuucccaaauauuucaagcacaauaauauggcaagcuuugugaggcaacugaauauguaugguuuccguaaaguaguacauaucgacucuggaauuguaaagcaagaaagagaugguccuguagaauuucagcauccuuacuucaaacaaggacaggaugacuuguuggagaacauuaaaaggaagguuucaucuucaaaaccagaagaaaauaaaauucgucaggaagauuuaacaaaaauuauaaguagugcucagaagguucagauaaaacaggaaacuauugaguccaggcuuucugaauuaaaaagugagaaugagucccuuuggaaggaggugucagaauuacgagcaaagcaugcacaacagcaacaaguuauucgaaagauuguccaguuuauuguuacauugguucaaaauaaccaacuugugaguuuaaaacguaaaaggccucuacuucuaaacacuaauggagcccaaaagaagaaccuguuucagcacauagucaaagaaccaacugauaaucaucaucauaaaguaauuuuuuaguuagggucuauuuuauauuuauugucucagacuaaauuuuauuauggcaguguuucaugcauucaaagaaguguggugaauaacaauucaaguguucaucccacagcuuuguuaaauugugacauuuuuuauuauuugcuuuagauuauuguaagaaauaaaucaucacaaaucuaguuccacacaguaggacugaagguuuaaagccaagggagaggauuucagaugacaucauuauuuaugauguuacugaugauaaugcagaugaagaaaauaucccaguuauuccagaaacuaaugaggauguuauaucugaucccuccaacuguagccaguacccugauauugucaucguugaagaugacaaugaagaugaguaugcaccugucauucagaguggagagcagaaugaaccagccagagaaucccuaaguucaggcagugauggcagcagcccucucaugucuagugcuguccagcuaaauggcucauccagucugaccucagaagauccagugaccaugauggauuccauuuugaaugauaacaucaaucuuuugggaaagguugagcuguuggauuaucuugacaguauugacugcaguuuagaggacuuccaggccaugcuaucaggaagacaauuuagcauagacccagaucuccugguugaucuuuucacuaguucugugcagaugaaucccacagauuacaucaauaauacaaaauuuagucugagaauaaaggauuagaaacuaccaagaacaauguaguucagccaguuucggaagagggaagaaaaucuaaauccaaaccagauaagcagcuuauccaguauaccgccuuuccacuucuugcauuccucgaugggaacccugcuucuucuguugaacaggcgaguacaacagcaucaucagaaguuuuguccucuguagauaaacccauagaaguugaugagcuucuggauagcagccuagacccagaaccaacccaaaguaagcuuguucgccuggagccauugacugaagcugaagcuagugaagcuacacuguuuuauuuaugugaacuugcuccugcaccucuggauagugauaugccacuuuuagauagcuaaauccccaggaaguggacuuuacauguauauauucaucaaaaugaugaacuauuuauuuuaaaguaucauuugguacuuuuuuuguaaauugcuuuguuuuguuuaaucagauacuguggaauaaaagcaccuuuugcuuuucucacuaaccacacacucuugcagagcuuucagguguuacucagcugcauaguuacgcagauguaaugcacauuauuggcguaucuuuaaguuggauucaaauggccauuuuucuccaauuuugguaaauuggauaucuuuuuuuuacaaauacgaccauuaaccucaguuaaauuuuuguuuguuuuccuguuugaugcugucuauuugcauugaguguaagucauuugaacuaaugguauaacuccuaaagcuuucucugcuccaguuauuuuuauuaaauauuuuucacuuggcuuauuuuuaaaacugggaacauaaagugccuguaucuuguaaaacuucauuuguuucuuuugguucagagaaguucauuuauguucaaagacguuuauucauguucaacaggaaagacaaaguguacgugaaugcucgcugucugauaggguuccagcuccauauauauagaaagaucgggggugggaugggauggagugagccccauccaguuaguuggacuaguuuuaaauaaagguuuuccgguuuguguuuuuuugaaccauacuguuuaguaaaauaaauacaaugaauguugaguacuagugucuguuaugugucuucuuuagaggugacacucacaugaaacaauuuuuucuucucauaggaagcaguagcuuuaaacugucugugguucauuauucucaauaugaaucauaccaagauauuugugccucaucucgaaaauauauuguauauug

SEQ ID NO: 1269 - RNA, 8294 nt, Homo Sapiens
ccggagcggccggggccacgauggagcgcgacggcugcgcggggggcgggagccgcggcggcgagggcgggcgcgcuccccgggagggcccggcggggaacggccgcgaucggggccgcagccacgcugccgaggcgcccggggacccgcaggcggccgcguccuugcuggccccuauggacgugggggaggagccgcuggagaaggcggcgcgcgcccgcacugccaaggaccccaacaccuauaaaguacucucgcugguauugucaguauguguguuaacaacaauacuugguuguauauuuggguugaaaccaagcugugccaaagaaguuaaaaguugcaaaggucgcuguuucgagagaacauuugggaacugucgcugugaugcugccuguguugagcuuggaaacugcuguuuagauuaccaggagacgugcauagaaccagaacauauauggacuugcaacaaauucagguguggugagaaaagguugaccagaagccucugugccuguucagaugacugcaaggacaagggcgacugcugcaucaacuacaguucugugugucaaggucaggugcucguugggcucugcagcagccugguaucuuccagcgucuuagcggggcuuuacauagguguuaucuuuuauauuaggagucauggcuauuggccaacuauauuagcugaaaaaaauaauuuuaaaacuuuuuauuaaagaaacuuuugugagaaaaguuggguagaagaaccaugugagagcauuaaugagccacagugcccagcaggguuugaaacgccuccuacccucuuauuuucuuuggauggauucagggcagaauauuuacacacuugggguggacuucuuccuguuauuagcaaacuaaaaaaauguggaacauauacuaaaaacaugagaccgguauauccaacaaaaacuuuccccaaucacuacagcauugucaccggauuguauccagaaucucauggcauaaucgacaauaaaauguaugaucccaaaaugaaugcuuccuuuucacuuaaaaguaaagagaaauuuaauccugagugguacaaaggagaaccaauuugggucacagcuaaguaucaaggccucaagucuggcacauuuuucuggccaggaucagauguggaaauuaacggaauuuucccagacaucuauaaaauguauaaugguucaguaccauuugaagaaaggauuuuagcuguucuucaguggcuacagcuuccuaaagaugaaagaccacacuuuuacacucuguauuuagaagaaccagauucuucaggucauucauauggaccagucagcagugaagucaucaaagccuugcagaggguugaugguaugguugguaugcugauggauggucugaaagagcugaacuugcacagaugccugaaccucauccuuauuucagaucauggcauggaacaaggcaguuguaagaaauacauauaucugaauaaauauuugggggauguuaaaaauauuaaaguuaucuauggaccugcagcucgauugagacccucugaugucccagauaaauacuauucauuuaacuaugaaggcauugcccgaaaucuuucuugccgggaaccaaaccagcacuucaaaccuuaccugaaacauuucuuaccuaagcguuugcacuuugcuaagagugauagaauugagcccuugacauucuauuuggacccucaguggcaacuugcauugaaucccucagaaaggaaauauuguggaaguggauuucauggcucugacaauguauuuucaaauaugcaagcccucuuuguuggcuauggaccuggauucaagcauggcauugaggcugacaccuuugaaaacauugaagucuauaacuuaaugugugauuuacugaauuugacaccggcuccuaauaacggaacucauggaagucuuaaccaccuucuaaagaauccuguuuauacgccaaagcaucccaaagaagugcacccccugguacagugccccuucacaagaaaccccagagauaaccuuggcugcucauguaacccuucgguaaguaucgucaagaaguuugguccaguauguaugguuugauagcacccucugcauagcaugugcuguaaaaauacuuaauaaucaaauuagaauuuaggaguggggguagguaaacauauguuuuaauucuagggggcgcauguagaucuuuugugauauaucuuuucucuuucuaguuuuugcauuuuccacucuauuuuuaauuccuuggagcugugacuugacuugggugcagguguggugaagucuaguuaguugacuuggguacggguguggagaagucuaguucaguucuugagcauccugaauuagggaaucugugcuguuaacucuagcagugaggugaugagcacauaguaaaccaaucacaauguaccuuuuuaaaaauacaauucagauuguuuaaauguagggagaaaaaagauuucuugguaugaaaugaauauauuacacuguccuuuuuuacuuccauguuaauaugucauuauuauaaaaagauaaaaauacuagacaaguuaugaacaaaauugauaacauccaugagggcaccuguaaucccagcuacuugggaggcugaggcaggagaauuguuugaaccugggaggcggagguugcagugagccaagaucacaccaucgcauuccagccugggcaacagggcaagacccuuucucaaaaaaaaaaaaaaaaaaaauuuugccgauugaggauuuucaaacacaguucaaucugacuguggcagaagagaagauuauuaagcaugaaacuuuacccuauggaagaccuagaguucuccagaaggaaaacaccaucugucuucuuucccagcaccaguuuaugaguggauacagccaagacaucuuaaugccccuuuggacauccuauaccguggacagaaaugacaguuucucuacggaagacuucuccaacugucuguaccaggacuuuagaauuccucuuaguccuguccauaaauguucauuuuauaaaaauaacaccaaagugaguuacggguuccucuccccaccacaacuaaauaaaaauucaaguggaauauauucugaagcuuugcuuacuacaaauauagugccaauguaccagaguuuucaaguuauauggcgcuacuuucaugacacccuacugcgaaaguaugcugaagaaagaaauggugucaaugucgucagugguccuguguuugacuuugauuaugauggacguugugauuccuuagagaaucugaggcaaaaaagaagagucauccguaaccaagaaauuuugauuccaacucacuucuuuauugugcuaacaagcuguaaagauacaucucagacgccuuugcacugugaaaaccuagacaccuuagcuuucauuuugccucacaggacugauaacagcgagagcugugugcaugggaagcaugacuccucauggguugaagaauuguuaauguuacacagagcacggaucacagauguugagcacaucacuggacucagcuucuaucaacaaagaaaagagccaguuucagacauuuuaaaguugaaaacacauuugccaaccuuuagccaagaagacugauauguuuuuuauccccaaacaccaugaaucuuuuugagagaaccuuauauuuuauauaguccucuagcuacacuauugcauuguucagaaacugucgaccagaguuagaacggagcccucggugaugcggacaucucagggaaacuugcguacucagcacagcaguggagaguguuccuguugaaucuugcacauauuugaauguguaagcauuguauacauugaucaaguucgggggaauaaagacagaccacaccuaaaacugccuuucugcuucucuuaaaggagaaguagcugugaacauugucuggauaccagauauuugaaucuuucuuacuauugguaauaaaccuugauggcauugggcaaacaguagacuuauaguaggguugggguagcccauguuaugugacuaucuuuaugagaauuuuaaagugguucuggauaucuuuuaacuuggaguuucauuucuuuucauuguaaucaaaaaaaaaauuaacagaagccaaaauacuucugagaccuuguuucaaucuuugcuguauauccccucaaaauccaaguuauuaaucuuauguguuuucuuuuuaauuuuuugauuggauuucuuuagauuuaaugguucaaaugaguucaacuuugagggacgaucuuugaauauacuuaccuauuauaaaaucuuacuuuguauuuguauuuaaaaaagaaaaauauuccuauccugcucacugguaauuaacauagguuuaaaauggcuucaaauguggcccuauagacgguuaaaauuguaccuuaucuuggcaaaacuucagagcaccagucagugcaugcaaggugccauuuuuuauugagaugcuuagaauguuucuuucugugcacaagacuuacccuaccagcagcagagccauucucuguugagugguucauuuugaaguuccacagauugaagagaacaugccaccaaucaccucacaucuucuugguggacaugauaaaugacacaaugaacuugauuucuuuacuaccuugacuguagcuuuuuaucccuaccugugaaccuucaaagacugcauuaacuuuuaggcuacauagguccaauugagguauaauaucaguacaccaaagauuuuuauauguccuucgugugaccauucuucaacggccuaagggccagcugcaaagacuuuuggaaaauacaauuuacaacucaaaauuauuuaauaauuuaggaaguugcuuuuuuuuuuuuuuuuuuucaguccugcaguuuccugaagcucuguauaugauauuuuuuucagccugcuucucucuguuguucagauuagguaauuuuauucuucugucucgaagcucacugauucuuuauucugucuaaucuguucugcuguugagcccauuuauuccugauuuuuauauuuuaguuauuguauguuuuauuucuaaaauuuccauucaguuuuucuuuauaucuucuauuugcugagaauuucugucucuuugcugagacuuucuacguuuucauuuguuucaagugcauuuauacuugcuuguugaagaauuuuuaugauggcugcuguaaaauccuuaucagauaauuccaacaucugucaccucauuguuugcaucuacugauggucuuuuuuccauucggaaacauuuuccuguuucuugguguguggaaugauuuuuuauugaaaccuggauauuuuuagguauuauguuaugagacuaugggucuuauuuaaaccuucugcuuuagccaacuuucucagauaccaccacagcaggggaauugggagcacugcuucauuauuaccagguguggcuaggaguccagguuccccagucagccucccuuuauacugaguaacaggguccccucauuacuacugggcaaggugagaauucaguuucccauuaggucuuuauugauucuucccuggcuggaaugugcagcggcaccuuuuggugcacccugggaaucuccacuaaugcuaugggacagagugaccaggaagagcuucauuacaccaggugggaaugaaauucccaguagccuacacagccuucuccgacaccacucuggaguuguauucuuccagcacacaaacauacacaauuuaacucaaagcaucuuagcagagcuuaauuaaauggauagaugccuguucccuuugcuggauaccaagaauacaaaagucagggaguuggggcaccucuuuacagcuuggugagaguguaagucuggacuccccacucagcauuugcugguauggguggggccaugguguuuuuccaugguguuugguuggaguacagccuuuuuuacccuugcuuggcuacccuuuucugguccuuuggcaggagagagcaggacucucuuagggcuuuuuuuuccccugcauuuauugacauuuccagguugcugacuuuuucagcuccaaguuggaaauauaugagcugaaaagaaaauguagggaacucaucacaguguuguuacuugggccccaauguuccuagccuauuuucugucuacuauucagagucuugcuguguuuuaauauaauauccaggauuuuuauaugcauuuagcagaaggaugucuacucugccuuuguagaagugucucacugauuuuuacauauuuuuccagcacacaaacauacacaauuuaacucaaagcaucuuagcagagcuuaauuaaauggauagaugucuguucccuuugcuggacgccaagaauacaaaaaagaacaagugacaauuuucucugucuuagggagaagagacagcagaaguguaaaugaucccuaaagagugauagauguuaucaugaagccacaggaggggugccaggcugcacaaaagagacacuggaugcuucuugguaguagaggcaguggcuucccagccuuggggcuaaggcuuguagggugaauuggaacuuuucagaugagcaaggcaaagaagggaccuucuaacauuccuuggauggaacauuuuugacauuuucccauuuacagcuacuuauauuuucuacaagugucacugugaccaacuuauguacacauacuuuuucuugcuuaguuauaauaaucuguucuuaaagaaaaugucagucucuacauucuaugcugacuguuaaggaaagagcacccacaucugcuccuacuuagcuuuuuuucugugguucuuacacaguauuccuuuuuuucuuuucuugaaagagacuccuccuuucuuuucuuuucuugaaagaguuuuaaacagauaagauggcaaaagugacugaucucuacucccccaguuugaaugguaaauuugaaugguaaauucccaugaacauauauggaaaugucuuuauccuacuuucuccaauaaaggcuguucuuagcuuuucaaaugcaaagugaaaccuuuauuuaucuugauuucuuuuuuuuuuuuuuuuuuuuuuuuuuuuuugagaugcucugucacccaggcuggagugcaguggcaagaucuuggcucacugcaagcuccgccucccagguucacgccauucuccuggcucagccucccgaguaacugggacuacaggcaccugccgucacgccuggcuaauuuuuuguauuuuuaguagagaauggaguuucaccguguuagccaggauggucucgaucuccugaccuugugaucugcccgccucggccucccaaagugcugggauuacaggcucgagccacugccuccagccuauccugauuucuacugucaugccucacaucaguccuuuuuuuuuuuuuugagacagagucucgcucuguggcccaggcuagacugcaguggcaugaucucggcucacugcaaccuccaccuccgggguucuagcaauucuccugccucagccuccugaguagcugggauuauaggcgcaugccacaccuggcuuuuuguauuuuaguggagaugggguuucacuguguugcucaggcuggucuugaucuccugagcucagacaauccccccgccuuggccucccaaagugcuaggauuauaggcgagagcugcugugugcuucuuaagugagguaaguaacuuccauagaaaauuuccaucaguucauucaugaaagaacaaagaaccuggcaaaacuuaaaaaaacguuuccaagaaucagauaaaagaggacaaaccuuagggagaagaaggcagcugcucauuuccagcaggggaaguagcugcauagaguacaaggacugguaggccuguuggcuguuccuguuuaaggagacaagaugggcauggaacagggaccacccccuccucugggagaagcuguuacccccuucacuuuuccuccucugucauuacccacaaucacucuccuucuuugcgcuaugguagguguuuacccaucauaggaaugggcauuugaacuuugaaacugaauguggugauuacacuucaugcugaagcuuuucacaugagugcuuucauaagcauuaaguaaaauuuuauaaugacugcaguccaaggacauuuucccugguuuuuggccagucuaaauauuguaagagagagagaagaaaaguguacggaauauaauugucucuaagcuaagaaauguggauguucaaauaaaacauacguacagaa

SEQ ID NO: 1270 - RNA, 73 nt, Homo Sapiens
guuugaaugaugacuuuaauugucggauaccccuucacuccuuuuaugagugaaacauaagagucugacaaac

SEQ ID NO: 1271 - RNA, 76 nt, Homo Sapiens
gcuguacaugaugacaacuggcucccucuacugaacugccaugaggaaacugccaugucacccuucugauuacagc

SEQ ID NO: 1272 - RNA, 97 nt, Homo Sapiens
ugugauguguauuagguuugugcaaaaguaauugggguuuuuugccguuaaaaguaauggcaaaacuggcaauuacuuuugcaccaaacuaauauaa

SEQ ID NO: 1273 - RNA, 444 nt, Homo Sapiens
auuagagauuguaacuuaggccucuuuaaauaggauuucugauuauucuaugauacuuuaagacauuuacuuauaccuaauguuaaaugacgaguuaaugggugcagcacaccaauauggcacauguauacauauguaacaaaccugcacauugugcacauguacccuaaaacuuaaaguauaauaaaaaaaaaucccccccucaaaaaaaagacauuuacugaaugccuacgauaugccagaaaugggcuguauuuacacaauacagaaaaagaaaagacaagcauugcauuuaagagcacagagcuggcuggguauggugcccucaugguuuauaauuucuaacugucuacuuaaaaugaagugauaugggagaaauuuaucuggacucaaaaucaggaagaauuuuauuuuuauuuaaaauuagcuuuauagacacuacau

SEQ ID NO: 1274 - RNA, 701 nt, Homo Sapiens
gaagcagcagcugaggagacuccgguguucaccauggccaacgaaaagcccacagaagaagucaagacugagaacaacaaucauauuaauuugaagguggcgggacaggaugguucuguggugcaguuuaagauuaagaggcagacaccacuuaguaaacuaaugaaagccuauugugaaccacggggauugucagugaagcagaucagauuccgauuuggugggcaaccaaucaguggaacagacaaaccugcacaguuggaaauggaagaugaagauacaauugauguguuucaacagccuacgggaggugucuacugaaaagggaaccugcuucuuuacuccagaacgcuguucuuuaaagaccaagauuacugcauucucaauuagaaaacugcaauuugguuccaccacauucugacuacuacaguauaguuuucucuauucuuuuguuucccccuuccacauucuuuuauuauacaugaaguaacugguauguguacacaagcauauugcuuuuuucuucaaaccaaacagccaaugguauguuuugauugacaucaaguggagacaggaugggaaaaaauacugauucugugaaaauacccccuuuauccauuaguggcauguucauucaggucuuaucuuuauauucuaguaaguuauuuugcucucacuguuuuaacaacaacaaaaaaaaa

SEQ ID NO: 1275 - RNA, 120 nt, Homo Sapiens
gucugcaauccuaucagccugaaugcacuuucucucauuugaucuugugaagguaagcaggguccagccugguuaguacuuggaugggagacccucugggaauauuggaagcuguaggcu

SEQ ID NO: 1276 - RNA, 69 nt, Homo Sapiens
ccauuccugcuggucaggaguggauacuggagcaauagauacaguuccacacugacacugcagaagugg

SEQ ID NO: 1277 - RNA, 1779 nt, Homo Sapiens
guauaaaagaccgagcugggggggcggcggcaggucucugcgcagcccagcccgccgguccacgccgcgcaccgcuccgagggccagcgccacccgcuccgcagccggcaccaugcgcgagaucgugcacauccaggcgggccagugcggcaaccagaucggcgccaaguuuugggaggucaucagcgaugagcaugggaucgaccccacaggcaguuaccauggagacagugacuugcagcuggagagaaucaacguguacuacaaugaggcugcugguaacaaauauguaccucgggccauccugguggaucuggagccuggcaccauggacucugucaggucuggacccuucggccagaucuucagaccagacaacuucguguucgguaaaagaagaguauucaaaagagaagaaucugccagucuaagaccaguccuaccuucuccuccauagucaaaaugacagauuuugaaauuccuuauguuuuagugucuaauguucacuuucccucuggcaggccagaguggagccgggaauaacugggccaagggccacuacacagagggagccgagcuggucgacucgguccuggauguggugaggaaggagucagagagcugugacugucuccagggcuuccagcugacccacucucuggggggcggcacgggguccgggaugggcacccugcucaucagcaagauccgggaagaguacccagaccgcaucaugaacaccuucagcgucaugcccucacccaaggugucagacacggugguggagcccuacaacgccacccucucuguccaccagcugguggaaaacacagaugaaaccuacuccauugauaacgaggcccuguaugacaucugcuuccgcacccugaagcugaccacccccaccuacggggaccucaaccaccuggugucggccaccaugagcggggucaccaccugccugcgcuucccgggccagcugaacgcagaccugcgcaagcuggcggugaacauggugcccuucccucgccugcacuucuucaugcccggcuucgcgccccugaccagccggggcagccagcaguaccgggcgcucacggugcccgagcucacccagcagauguucgacuccaagaacaugauggccgccugcgacccgcgccacggccgcuaccugacgguggcugccaucuuccggggccgcauguccaugaaggagguggacgagcagaugcucaacgugcagaacaagaacagcagcuacuucguggaguggauccccaacaacgugaagacggccgugugcgacaucccgccccgcggccugaagaugucggccaccuucaucggcaacagcacggccauccaggagcuguucaagcgcaucuccgagcaguucacggccauguuccggcgcaaggccuuccugcacugguacacgggcgagggcauggacgagauggaguucaccgaggccgagagcaacaugaacgaccugguguccgaguaccagcaguaccaggacgccacggccgacgaacaaggggaguucgaggaggaggagggcgaggacgaggcuuaaaaacuucucagaucaaucgugcauccuuagugaacuucuguuguccucaagcauggucuuucuacuuguaaacuauggugcucaguuuugccucuguuagaaauucacacuguugauguaaugauguggaacuccucuaaaaauuacaguauugucugugaagguaucuauacuaauaaaaaagcauguguagaaaa

SEQ ID NO: 1278 - RNA, 661 nt, Homo Sapiens
gaaagauuagcugaguuuuucugcugacuuaacuguugaauagcaucauccucaggcacuaccaaaaguguuuagagcacucuguugaaaauggcaguauuugaagaaacuggaugucacuuaaaauaugauccuuggauaaacaucacaugcugcuggccuucuuacaaaaugagugugagugaagugcuuggcucugcgagaugguccuggaauaucuucaccacucuucacaauuacguccucuugcauucccacugauccuucagaauuguguggccuuucaacuuucugaaaggccuucacugucucuuaauucaaauucuccacauguaaauacaagucagaucaccuuacaauuuaaucuuuaagcaaaacuguaaaucaucauuucccgcgacauuacaauuguugggggaaagguguuuggugucacaucuaauggcuugaaaacucggagcaucucuggacacagucaauauccaggucucaaauaugcauuuacuguguuuauuauaaugacugccuuuguauucacugcaaucauuuucuacuguuucuuccuuuguguaaucauuucuucccuuccccuccauuguauuuuuuuagaguaauucuauauucuguuuuugaauacacacuucucuuucuuuuaaaauaa

SEQ ID NO: 1279 - RNA, 11019 nt, Homo Sapiens
cgggauggcccgcgcgccucggcgcugccucucggagcucacggcggagcggcggcggccgcgcucgaggggcgcgcggcugcagcggcggcggcgccgcgcgugaggggccgccuaaggccgagcgggcgcggcgagcggccgggcgagcgcagccaacaugucggauaccaagguaaaaguugccguccggguccggcccaugaaccgacgagaacuggaacugaacaccaagugcgugguggagauggaagggaaucaaacgguccugcacccuccuccuucuaacaccaaacagggagaaaggcuggucacaguggcucacaucucuaauuccagcacuuugggaggccaaggcaagaggaucacuugagccgaggauuucaagaccagccuuugcaacauggcaaaaccccaucucuacaaaaaauuuguuuaaaauuagcuggacgugguggcgcauaccuguggucccagcuacucaggagacugaggcaggaggcuccagugagcuguuugagccacugcacgccagccugggugacagagccagacccugucuucaaaaaaauaaaaaauuaaaguggcgugaggugaauugcaucagaccccacauaugaauaaauggaugguuggcaaaguguuauauauaauaaguacaauuccuuagguguccuuagguguacuacuaaaguggguuugugauagcccauauauuuagucauuuauguucaauaguguuauauucauuugagaaauuauuuuaagaaauuuaaaauuaagaaaguuuuaaaaguccuuuaguaauuagagauuucucuggguggguggauacgguuguuucuaauuaucccacacauuuaaucauuuauguucaauaguguuguauuuuuugagaaauuauuuuaagaaaugcaaaauuaagaaagauuuaaaaguccuuuaguaauuagagauuuuucuaguuggguggauaaggguuauuucuaaguaucuuuugaguauuuuuugucauauauuucguuuuuuaggcaugauuaaaaguguauuugaggacucuuagacacauaaaguugaauuccucagauugagagauaguuauugcuuuuuaauuuuguuaagaugcucagcuguuggauaaauaaugcuuuuguuaaaauccuguggggcauucauccaacaaaugggguauaagaaaggaauguguguuuguguacauguucuucuaucuguugguccuaaagaguguaagaagguaaauuugaccagugaaauucauaauuacagaguuuuauuugguaauccauuaauaaaucauuuucugaaagcagaggccaaggaaaccucccaagucagguauuugccuuugauuauugcuuuugguccauggaugaaucuaacacuacaaaauacgcugguaaguuuucucccucuacaccugacaguugggcuucuggccucuucuuccauugaguuuauuuucuuuaauuccucuggaguuuuacuuucccuguguaauucacaccuguucgucaagaagugguuuucaagugccuuggggaaggaauucuugaaaaagccuuucagggguauaaugcguguauuuuugcauauggacagacagguucgggaaaauccuuuuccaugaugggccaugcugagcagcugggccuuauuccaaggcucugcugugcuuuauuuaaaaggaucucuuuggagcaaaaugagucacagaccuuuaaaguugaaguguccuauauggaaauuuauaaugagaaaguucgggaucuuuuagaccccaaagggaguagacagucucuuaaaguucgagaacauaaaguuuugggaccauauguagaugguuuaucucaacuagcugucacuaguuuugaggauauugagucauugaugucugagggaaauaagucucgaacgguagcugcuaccaacaugaacgaagaaagcagccgcucccaugcuguguucaacaucauaaucacacagacacuuuaugaccugcagucugggaauuccggggagaaagucaguaaggucagcuugguagaccuggcggguagcgaaagaguaucuaaaacaggagcugcaggagagcgacugaaagaaggcagcaacauuaacaaaucgcuuacaaccuugggguugguuauaucaucacuggcugaccaggcagcuggcaaggguaaaagcaaauuugugccuuaucgagauucaguccucacuuggcugcuuaaggacaacuuggggggcaacagccaaaccucuaugauagccacaaucagcccagccgcagacaacuaugaagagacccucuccacauuaagauaugcagaccgagccaaaaggauugugaaccaugcuguugugaaugaggaccccaacgcaaaagugauccgagaacugcgggaggaagucgagaaacugagagagcagcucucucaggcagaggccaugaaggccccugaacugaaggagaagcucgaagagucugaaaagcugauaaaagaacuaacagugacuugggaagagaagcugagaaaaacagaagagauagcacaggaaagacaacgacaacuugaaagcauggggauuucccuggagauguccgguaucaaggugggggaugacaaaugcuacuuagucaaucugaaugcagacccugcucuuaacgaacuucugguuuauuauuuaaaggaucacaccagggugggugcagauaccucucaagauauccagcuuuuuggcauaggaauucagccucagcacugugagauugacauugcaucugauggagacgucacucucacuccaaaagaaaaugcaagguccugugugaacggcacccuugugugcaguaccacccagcuguggcauggugaccgaauccuauggggaaauaaucacuuuuuuagaauaaacuuaccuaagaggaaacgucgagauugguugaaagacuuugaaaaagaaacgggcccgccagagcaugaccuggaugcagccagugaggcuuccucugaaccagacuauaacuaugaauuugcacagauggaaguuaucaugaaaacccugaauaguaaugacccaguucaaaaugugguucagguccuggagaaacaauaccuagaagaaaagagaagugcccuagaggagcagcggcucauguaugagcgggaacuggagcaacuccgccagcagcucucccccgacaggcagccacagaguagcggcccugaccgccuggccuacagcagccagacagcgcagcagaaggugacccagugggcagaagagaggaaagacauggaaucaaccuaaauguccaacgauagacuggauaaagaaaacgugguacauguacaccauggaauacuaugcagccaugaaaaacaacaagaucguguccuuugcaggaacauggauggaacuggcggccaucauucuuagaaaacgaaugcaggaacagaacaccagauaccgcguguucucacuaauaagugagagcuaaaucaugggaaccgauggacagaaaggggaacaacagacacuggggccugugggaggaggagggagaggcucaggaaaaaaaaacaaaaaccugccaaguacuaugcuuacuacccggguaaugaaauaauccauacaucaaaccccuuagucaugaguugaccuguauaacaaaccugugcauguaccccugaaccuaaaauaagucaaaauauuuaaauuuuaaaaaacaaaaguaucugauaaagaaggugguuugcuuuuaaccauaguguuuuucaguuaaauaguuaaaaauauuuuuuugauuucccuuaauuccagauugauuuucuuuggggcuuaaauucuuaaaaggaugaacucuuccgacaaagccuggcaaaacugcgagagcagcugguuaaagcuaauaccuuggugagggaagcaaacuuccuggcugaggaaaugagcaaacucaccgauuaccaagugacucuucagaucccugcugcaaaccucagugccaauaggaagagaggugcaauagugagugaaccagcuauccaagugaggaggaaaggaaagagcacccaaguguggaccauugagaagcuggagaauaaauuaauugacaugagagaccuuuaccaagaauggaaggaaaaaguuccugaggcaaagagacucuacggaaaacgaggugacccuuucuaugaagcccaagaaaaucacaaccucaucgggguggcgaauguauucuuggaaugccucuucugugaugugaaacuucaguaugcagucccuaucaucagccagcagggggagguugcagggcgucuccacguggaagugaugcguguuacaggagcuguuccagagcgugugguggaggaugacucuucggagaauuccagugaaagugggagccuugaagucguagacagcagcggggaaaucauucaccgagucaaaaagcugacaugucggguaaaaauuaaagaagcaacggggcugcccuuaaaccucucaaauuuugucuucugucaauacacauucugggaccagugugagucuacgguggcugccccggugguggaccccgaggugccuucaccacaguccaaggaugcccaguacacagugaccuucucccacuguaaggacuauguggugaauguaacagaagaauuucuggaguucauuucagauggagcacuggccauugaaguauggggccaccggugugcuggaaauggcagcuccaucugggaggucgauucucuucaugcuaagacaagaacacugcaugacagaguugcuacgggaauguggggauugaaugggaaugcauaugagcaaacuuucugaggugauagggcagguuacacucauaugugcauuucucaaaacucaucgagcucuauacucaagauguggacauuucagucuaccucaguaaaauaaauaaaaagaaacaauaugacagguggaaugaaguaacgcgaagaauagaaauguggaucuccauauuagaauugaaugaguuaggagaguaugcugcaguggaacuucaucaggcaaaagaugucaacacaggaggcaucuuucaacuuagacagggucauucccguagaguacaagucacggugaaaccugugcagcauucagggacacugccacuuaugguugaagccauccugucaguauccaucggcuguguaacugccagguccaccaaacuccaaagagggcuggacaguuaccagagagaugaugaggauggugaugauauggauaguuaucaggaagaagacuuaaacugcguaagggagagguggucagaugcacucauuaaacgacgagaauaccuggaugaacagauaaaaaaagucagcaauaaaacagagaaaacagaggacgauguggagcgggaagcccagcuuguggagcaguggguagggcugacugaggaaaggaaugcugugcuggugccagccccaggcagugggauuccuggggcaccugccgacuggaucccaccuccuggaauggaaacccacauaccaguucucuuccucgauuugaaugcggaugaccucagugccaaugagcagcuuguuggcccccaugcauccggcgugaacuccauccugcccaaggagcauggcagccaguuuuucuaccugcccaucauaaagcacagugaugaugagguuucagccacagccucuugggauuccucggugcaugauucuguucacuugaauagggucacaccacagaaugaaaggauuuaccuaauugugaaaaccacaguucaacucagccacccugcugcuauggaguuaguauuacgaaaacgaauugcagccaauauuuacaacaaacagaguuucacgcagaguuugaagaggagaauaucccugaaaaauauauuuuauuccugugguguaaccuaugaaauaguauccaauauaccaaaggcaacugaggagauagaggaccgggaaacgcuggcucuccuggcagcaaggagugaaaacgaaggcacaucagauggggagacguacauugagaaguacacucgaggcgugcugcagguggaaaacauucugagucuugaacggcuccggcaggccgucacagucaaagaagcacuuuccaccaaagcccggcacauucggaggagccucaguacaccaaauguucauaaugucucuuccagccgaccggaccuuucuggcuuugaugaagaugacaaggguuggccagagaaccaguuggacaugucugacuauagcuccaguuaccaagauguagcauguuauggaacuuuacccagggauucuccucgaaggaauaaagaagguuguacaucagagacuccucaugccuuaaccgucagcccuuuuaaagcauucucuccucagccaccaaaguuuuucaagccccuaaugccuguaaaagaggagcauaagaaaaggauagcccuggaagcaaggccucuucuaagccaggagguaaaugcuugacuugucuguacuaugcagaauagagcagaguugugucaccugugaagcagcagugugcauuaacaagcugagugcugcauguggacaugcacggucaucacuccaugguucccguucucgaauuccucuuucucaagcaugcagagucaugguagaaucucuuguuuguuguugcugcugugguuuuauuucuuuguguuuauggcuuuucaaaguauuuuuuuauguuucaagugagaaagauguuuucuagguguuuugaaaagauuaaaggccuuuuuuaaaauuauuuuucuuuuuugucuuuuuggggauuucugauuuuguuuuuuauagagauagggucuugcuguguugcccaggcuggucugaaacuccuggccucaagugauucuuuugccccagccucccaaggcacugggauugcaggcaugagccguuguaccuggucaaaaggcuguuuuuuaaauaagacuaauuaugcuuuuugccacagaaucuguuuauuccugucauaucucuccaguaguuuaacucuggccugcagaauuggcugcugcauuacucacauguaauaagaguguuagcauugcuuuucuaacuugcauguacuuaauauguauuuuggccguugucgucuuugugugugaugcaucugugugucuuaaccuuugcagagcaugccuccaccucaggcacauaacccuggcugcauuguacccucaggaagcaauggcagcagcaugccaguagaacacaauagcaaacgugagaagaagauuguaaguuccggaaccauuucugucauauugccuggugguggguuuaaggcccuuucacagacaaucauccaaaugcuagaagaaauuaagacauguauugggucuuugucuuaaagaaaauaaaaaugugaccauugguaaugauauuuugcauggauguggccaugaccuacaauuuuaucuuauuuauuuauuuauuuuuugcuuaaguuugcuuagaaaaagggagaaaggcacuuuuauugcuucuggccuuuauaaaaaguguaacaaagagaucuuuuuaauaccaaaaucuuucuaaugugccuauacauauugccuagauucugaaguuaaucuaccuagaggaagugcacuuacuuggaguaaguaaucaugcauuuaaugcauuuagcuguggauauguuuggaagcuuuuuuauguugccugaugcuauugccaagauaauucuguaguuagagcugcacuacaaucuaucauaaucacccuucaucgucucacugucuaggguagccuuuguuaauuagcuggcaaaauauauuccaauaccuuggugccagccuugcauucaggauggcuuauauauauuuugccacagguaggcugaaacucuacccacaaaaccucauuccuuagcacuugguuuuaaaauuauuaauuugagauacaguuuuaaaaacacugcauaccaggcaccuuagguuauaaauuauaccucaauuuacaaaaaaaaaaaaaaaaaaaagacucugaggaggaagaaaaugagcuggaagcuauuaacaggaagcuaauaaguucacagccuuauguaccuguggaguuugcugacuucaguguuuacaaugccagcuuggagaacagggaaugguuuuccucuaaaguagaucugucaaacucacgggucuuggagaaagaagugucccguagcccuaccaccagcaguauuaccaguggcuacuuuucccacagugccuccaaugccacccugucugacaugguggucccuucuagugacagcucagaccagcuggccauucagacgaaggaugcagacuccaccgagcacuccacaccaucgcuugugcaugauuucaggccguccucaaacaaagaguugacagaagucgaaaaaggcuugguaaaggacaagauaauuguggugccacucaaggaaaacagugccuuagccaaagggagcccaucaucccagagcaucccugagaaaaacuccaaaucacugugcaggacuggcucauguucagaacuagaugccugccccagcaaaauuagccagccagccaggggauucugccccagggaggugacgguagaacacaccaccaacauccuugaagaccauucuuucacagaauuuaugggagugucagagggaaaagauuuugaugguuugacagauucuucugcuggagagcuuuccaguaggaggagucuaccaaauaaaacaggcggcaagacugucuccgaugggcuccaccaccccagccagcugcauuccaaguuagagaaugaccagguaauaauuccagaggcagccuuuuggguucugugcugucaaugaguaugucuaacuguaugucaaccccagaggcccuucaccgcaacaacuugguaggaaagauucauccaguuguuugugacagcaaagaugagcccacagagaagcaggcucacuuccugcacagcugucucugucggagagcaagucuguuuugggaacuagaacgcaauugugaaauuauaagaccaguggauuuuuuuaccuggcacauggguugguguugaaugaaguguucagauggauaaggaucaaucucauauucauucccugggauguuuaguuaccaguuuucccaaaguguucugguagcaucuaccauauuucaucaaaucugugauuccuuugauuauuauaugaaccauuauuuuauguaucauuaagaaaaaauacugccaauuaaacucugucauaucaacaggaggcacaaccucacggugagagcagcaagcaccccuccucaggccacagcuuggcgucuuuguucgccuggucaccuugggcaagcaccagccccaucucuaaaacaugcugccgccuggcuggaccucagaccagaagcuggagaauccacaccgugcacuuccugggccaccuccuuuccccuccccagugggagaagcggcacuuugucacuugggugaaucaacagccucugcuuuuuccagaaagcaagagaacugaaaauccuggauuaacuaagugacaguauuuuuuuuugcacuuacuacacaccuccacuguauagaaaccucuacagauuccaacagacuuuauucuuguacaauuuuaaucaguucuuacuguagaaucuggagucaaugcucuaaucuguuuuuuauaaauaauauauauuauguauaugaaauguguaucuauaguaugucuggagacagacaaggcugcacacuaaaaugcagauaaaggugauuuguagaaaaucauaagguacuggacuucguuacaaagcaacuugggcgaucucuuauacaugagcagaugaaaaauauuuuauugccuaagaaugagcuugcaaaucccucuuugcagaaaagguuauagaaugcuguucuuuauaaccaaagaacuuacauaagacaacauuuuugcuguccacucuuuugugugaacauguauguuugacugcaaguuuggugccauaauucccuuggcuaccaagccacgugcugccauucucuguccuuuguuucauaagcacacugagaaaucucacagcuauauucuuuggucuuccaccugccccuccaccugcugacuugacauuguauuauaacuguugacaaugacugggguccugacuccacaguugccuggaccguggcucagcccagcugggcagguggaaugaagagagccguauuacuguaagaaaacacaaggacagccaggaguaguggugggguggguggggugggagguguugauuuuuguguguuucugugugugugguuuuguuuuggauugguagguuucacuguggcgugguuuugcuguuguuauuuugcuugauucuggaaaaugcugaggagauggacugagcuaugaaguucaaugguucacccuuuaccauguuugcaggagaugaucgaauacagaugacccugcugucgugucuucauuuguaaaauucuccuacaaauggagacauugaaggauuauguguauggaaauuuuuacaaaauuccuuucuguaccuauucuguagaugccuguauaaucggucuggauguacagcuauaaauguguugugagagcaagagagagagaauggguagagccugcuguaccuuuuuucuuuuaaauucuucgaguugguaaaugaguaagauauuggaaaccuuaaugaaaagcugcuguucaugauuuguguguauagugagcugacuguaguauuuuacuauugucuguuaaaaaaagaaaaacuguaauuuauauccccuuugaacuuuauuguguuuaauugguacacauuucuguguguguguguguguauguguuuuagaauacaaacuguguaauucagauuuuaaaacacuaaucauuugucuuuaauaacccugccuuuaguuucaaaucuaacuuaccauauuucua

SEQ ID NO: 1280 - RNA, 1212 nt, Homo Sapiens
gggcagaggaaauguggaaaaaagagagagccacaggugucacaugccauucuucugauuuucaugaauauccucuaaaaggcagcuaagcacucgcugucuucuuccuuuugccucaucaagcacgggggacgcuggaaggaagaggcuccagggaccuaccugacuuccuauucaugcugaucccacugagacccuuaucaacccugaccuguuccccaugugccucuuggaucugccuuauguuccaggaacuaacguucacuacagagaacuucagguugcaucagggaacauauauacacagcagucagacacucagugauacagaauugaaaaagagaaagaccagauuucccauggagauggagaaauuggaagcccagauccagcagauaagccaguacuuaaugccaauaauugcuccaacugggguggaaaauggauauuuauacuucaaauuuguggauaucaguuuuccagaaggggaaaacaggauuggcuccuacuucagaaaaugaucuaggggugaagagguccuuacuggccuuuuccccacugagucccagcuggucuccugacaggggauuuuggggaccgauucaccaaugugugacaguauccaugcauaaagaugugaacugucuucuccccaaacuuuuaaucuauguaaaugcaacgcuacauuccaauguauuucuaagacaguuuugcucuaugccaaucagcagaugagccggggcucauuuuuuguggggucuggcucuuaccuguuuccucugaaauccuauaagauuuuauuuuuucuucucuuggacauaucacguauuuccuugauuucuacuuaucgcaguaacugucuuuucauucacauuaagguaacuuuauauuguggagucagacaguucucugucugcuacuuaccaacugucagaucuuguuugagcaaacgaauuauauucuuugagccucaguuucuuuaucuaucaaacggggauaauuauuuccaagcucaaaaugcuguuguaaguaugaauuagaauaaugaauauaaaauaugguacaugcuagucauucauaaguuuuuccuuaaaaguagacuguuucguauuuauauuuauaucucccacagugccucaaucauaguagaugcucaauaaauuauuuguacaguugagccgaaaugccuguucuaacaaagagagccugggu

SEQ ID NO: 1281 - RNA, 445 nt, Homo Sapiens
caugccugaaccagcuaagucagcuccugcuccgaagaaggguuccaagaaggcugugaccaaggcgcagaagaaggauggcaagaagcgcaagcgcagucguaaggagagcuacuccguguauguguacaaggugcuaaaacagguucaccccgauacuggcaucucauccaaggccaugggcaucaugaauuccuucguuaacgacaucuucgaacgcaucgcaggcgaggcuucccgucuggcccacuacaacaagcgcucgaccauuaccuccagggagauccagaccgccgugcgucugcugcuucccggagagcuggccaagcacgcaguguccgaagguaccaaggcugucaccaaguauacaagcuccaaguaaaugugugcuuaggugcuuuaaaacucaaaggcucuuuucagagccacucaagucucacauaaa

SEQ ID NO: 1282 - RNA, 477 nt, Homo Sapiens
uuagccauggcacgaacaaagcaaacagcucgcaaguccaccggcggcaaagcgccgcgcaagcagcuggccaccaaggcggcucgcaagagcgcuccggccaccgguggcgucaagaagccccaccgcuaccgccccggcaccguggcccugcgcgagauccgccgcuaccagaagucgaccgagcugcuaauccggaagcuaccuuuucagcgcuugguacgggagaucgcacaggacuuuaagaccgaucugcgcuuccagagcucggcggugauggcgcugcaggaggcuugcgaggccuaccugguggggcuauuugaggauaccaaccugugcgccauucacgccaaacgcgucacuauuaugccuaaagacauccagcuugcgcgccgcauccgaggggagagggcauaaauauuccuaucagcccaagaagucuguccaaccccaaaaggcucuuuucagagccccuca

SEQ ID NO: 1283 - RNA, 496 nt, Homo Sapiens
agcauagcuuucucaacuauggcccggacgaagcagacagcucgcaagucuaccggcggcaaggcaccgcggaagcagcuggccaccaaggcagcgcgcaaaagcgcuccagcgacuggcggugugaagaagccccaccgcuacaggccaggcaccguggccuugcgugagauccgccguuaucagaagucgacugagcugcucauccgcaaacugccauuucagcgccuggugcgagaaaucgcgcaggauuucaaaaccgaccuucguuuccagagcucggcggugauggcgcugcaagaggcgugcgaggccuaucuggugggucucuuugaagacaccaaccucugugcuauucacgccaagcgugucacuauuaugccuaaggacauccagcuugcgcgucguauccguggcgagcgagcauaauccccugcucuaucuuggguuucuuaauugcuuccaagcuuccaaaggcucuuuucagagccacuua

SEQ ID NO: 1284 - RNA, 2569 nt, Homo Sapiens
gcgugugcuauguggggcgggccuuggcugcgugaaggcuucuugugggaaguagccaaagacauccuuuggugauacuuacugugggauucagaguggggugcagaggacgacccugcaaaggcacggacuauaagagagaucugugcagcugcgccucaggggguguccugggccccugggcaugacaggagggggaccacuugcaguucuacuggaaaauuuaccacccuuccagaauccucugaagauauacaggucgcaacuagagugagacccgaguacugccuugggucagaauggcuagagaaccgagaaaaaacgcagcccuggacgcccagucugcagaagaccagacggggcuccugaccgugaagguggagaaggaggaagccuccgccuugacggcggaggugagagcacccugcagcccugcucggggccccgaacgcucccgccagcgcuuccgaggcuuccgcuacccggaggcugcgggcccccgcgaggcguugagccggcuccgagaacucugcggacaauggcugcagccugagaugcacagcaaggagcagauccuggagcugcuggugcuggagcaguuccugaccauccugccggggaaucugcagagcugggugcgggagcagcauccagagagcggggaggaggugguggugcuauuggaguauuuggagaggcagcuggaugagccggcgccgcagguagaaagaacagguuuaguaucugagcgcugugcgaggggcauuccuuuaagguccaggaguucuucaucucuuuuuguacuguucccguuggugaccaggggcaagaacugcucuguugcaagauggcacuauugacacaaacucaagggucucaaaguagccagugccagccaaugaaggcucuguucaagcaugaaucucugggaucccagcccuuacacgauagaguucuccagguuccugggcuugcccagggagggugcugcagagaagaugcaaugguagcuuccaggcucacuccagggucccaggguuugcugaaaauggaagauguggcccugacccucacuccuggguggacacagcuggauucaucucaggugaaccucuacagagaugaaaagcaggagaaccauagcagccuggucucccuugagcuuuccucccauggcagggcauaacccacaguugccggccauuuguuguuucagguggugaaauacagacuaagagcagggacuugccuccagucaagaagcuuccagaaaaggagcaugggaagauaugccaccugagggaagacauugcccagauuccuacacaugcagaagcuggugaacaggagggcagguuacaaagaaagcagaaaaaugccauagggaguaggcgacauuauugccaugaauguggaaagaguuuugcucaaaguucaggccugacuaaacacaggagaauccacacuggugagaaacccuaugaaugugaagacuguggaaagaccuucauugggagcucugcccuugucauucaucagagaguccacacuggugagaagccauaugagugugaagaaugugguaaggucuucagucacagcucaaaccuuaucaaacaccagagaacccacacuggggagaagcccuaugagugugaugacugugggaagaccuucagccagagcugcagccuccuugaacaucacaaaauucauacuggggagaagccauaccagugcaauauguguggcaaagccuuuaggcggaauucacaucuccugagacaucagaggauucauggugauaaaaauguucagaauccugagcacggggaguccugggaaagucaggguaggacggaaagccagugggaaaauacugaggcucccgugucuuauaaauguaaugagugugagagaaguuucacacggaauagaagucuuauugaacaucagaaaauccacacuggugagaaacccuaucagugugacacauguggaaaagguuucacucgaacuucauaccuuguucaacaucagagaagccauguagggaaaaaaacucuuucacagugacccaugguauucaugccaacauuggugcucauuugucacugaacugaagccacccuggagcccuuaaugguuacagaaauuguggaccagggcuuuauuuaccacuauacaucaucggguauuagaaaauguagucuggcugagacgaugaguuaucuucuacauucuagaaagugauuggaagaagucauuugauaagaggccaugggagaguggucuggaaguuguaggaccuaaaauaguuuguucucacccaguguauuuaaauggccuucuggacuuguuaauugcccucagccagcacuuuaggacaucugguuggauggcucugauguggggggcugcugcucugaccauucauuuugccucuaaugaaucuuucacaaauuggucagauccaugaggucuuuuacucuucuuugugccuuguaugauaggugcuaauaaacauuuauuaaauguaccaguaaaauggccuuuguaccaaaaauuu

SEQ ID NO: 1285 - RNA, 76 nt, Homo Sapiens
gccaaaugauguuuauuugaaacaggagcaccucagugcaaggacgacucuuaucuaucacccaugacugauggcu

SEQ ID NO: 1286 - RNA, 1229 nt, Homo Sapiens
aguaacuuccucccuauaacuuggaauguggguggagggguucauaguucucccugagugagacuugccugcuucucuggccccugguccuguccuguucuccagcauggugugucugaagcucccuggaggcuccugcaugacagcgcugacagugacacugauggugcugagcuccccacuggcuuugucuggggacacccgaccacguuuccuguggcagccuaagagggagugucauuucuucaaugggacggagcgggugcgguuccuggacagauacuucuauaaccaggaggaguccgugcgcuucgacagcgacgugggggaguuccgggcggugacggagcuggggcggccugacgcugaguacuggaacagccagaaggacauccuggagcaggcgcgggccgcgguggacaccuacugcagacacaacuacgggguuguggagagcuucacagugcagcggcgaguccaaccuaaggugacuguauauccuucaaagacccagccccugcagcaccacaaccuccuggucugcucugugagugguuucuauccaggcagcauugaagucaggugguuccugaacggccaggaagagaaggcugggaugguguccacaggccugauccagaauggagacuggaccuuccagacccuggugaugcuggaaacaguuccucgaaguggagagguuuacaccugccaaguggagcacccaagcgugacaagcccucucacaguggaauggagagcacggucugaaucugcacagagcaagaugcugaguggagucgggggcuuugugcugggccugcucuuccuuggggccgggcuguucaucuacuucaggaaucagaaaggacacucuggacuucagccaacaggauuccugagcugaaaugcagaugaccacauucaaggaagaacuuucugccccggcuuugcaggaugaaaagcuuuccugcuuggcaguuauucuuccacaagagagggcuuucucaggaccugguugcuacugguucggcaacugcagaaaauguccucccuuguggcuuccucagcuccugcccuuggccugaagucccagcauugauggcagcgccucaucuucaacuuuugugcuccccuuugccuaaaccguauggccucccgugcaucuguauucacccuguaugacaaacacauuacauuauuaaauguuucucaaagauggaguuaaa

SEQ ID NO: 1287 - RNA, 6036 nt, Homo Sapiens
gugcacugcuguauguucaggacacgaggccuggcaccaaauaggcccucgaucaagaauagcaaaaccucggagagagaaggagccuugguauacagguuuaccaaauaccaaggggaucccacgacucagguaugaggagggcgacccagguaccacuuuccuggcucccuagcccagcugcucaugcuccucuuccucguccccucccccacucucaucuccucagcccgcccggaacgcccgcgggcuaggccacaacggcucgggaaccgccgccgguauccgcguccgcagcgccgccagccaggcgagagccgugugggaucccagcgcccgcacucccgcccccgccaaggagccaggugagccgcugcugggagacgccugggcgccgggggcugcaggucccagggcgggggcugcguccgucaccggcagguacccagguaugccgcagagccaggcacgccgugggcacucagucaguaucuguggaaugaaugaaugauggucgucccugggagcuuaucucugaggaauggcacaacuagagaggagcgccaucucuggcuucagcucuaaguccaggcgaaacucauucgcauaugauguuaagcgugaaguauacaaugaggagaccuuucaacaggaacacaaaaggaaggccuccucuucugggaacaugaacaucaacaucaccaccuucagacaccacguccagugccgcugcucauggcacagguuccuacgaugcgugcuuacaaucuuucccuuccuagaauggauguguauguaucgauuaaaggauuggcuucugggagacuuacuugcugguauaaguguuggccuugugcaaguuccccaaggccugacacuuaguuugcuggcaaggcaacugauuccuccucucaacaucgcuuaugcagcuuucuguucuucgguaaucuauguaauuuuuggaucgugucaucaaauguccauugguuccuucuuccuggugagugcucugcugaucaacguucugaaagugagcccauucaacaacggucaacuggucaugggaucuuucgucaagaaugaguuuucggcccccuccuaccuuaugggcuauaauaaauccuugagugugguggcaaccacaacuuuucugacugggauuauucagcuaauaaugggcguauuggguuugggcuucauugccacuuaccuuccggagucugcaaugagugcuuaccuggcugcuguggcacuucauaucaugcugucccagcugacuuucaucuuugggauuaugauuaguuuccaugccggucccaucuccuucuucuaugacauaauuaauuacuguguagcucucccaaaagcgaauuccaccagcauucuaguauuucuaacuguuguuguugcucugcgaaucaacaaauguaucagaauuucuuucaaucaguaucccauugaguuucccauggaauuauuucugauuauuggcuucacugugauugcaaacaagauaagcauggccacagaaaccagccagacgcuuauugacaugauuccuuauagcuuucugcuuccuguaacaccagauuucagccuucuucccaagauaauuuuacaagccuucuccuuaucuuuggugagcuccuuucugcucauauuucugggcaagaagauugccagucuucacaauuacagugucaauuccaaccaggauuuaauagccaucggccuuugcaaugucgucaguucauuuuucagaucuuguguguuuacuggugcuauugcuaggacuauuauccaggauaaaucuggaggaagacaacagcuuucuuucuuuuugauggcacuggagcagagagaaacuaaagcaggaaaaugggaagugauuaucuuuguguuuuuuaagaugaagcuccacugaagcugcuagaugggcaguuacccaagcagcaaacaggagagugaggggugggaaauuuacuuacaugggaaguagggcugacacugaggagcuacuagggcuuuucuuuccuuauauuuauuuuuuuuuugagauggagucucacucugucgccaggcuggagugcaguggcgugaucuuggcucacugcaaucuccgucucccggguucaagcgauucuccucucucagccucccaaguagcuggaauuacaggcacacaccaccaagcccagcuaauuuuuguauuuuuaguagagacgggguuucaccauguuggccaggauggucuccaucuuuugaccuugugaucugccggccucagccucccaaugugcuaggauuacaggugugagccaccgcacccggccaacuacggcuuuucuaaauugugcaaggagagguuaaacuuaggaggagaugcaaaucagauuuuaggagaauucagauucauagcacagagcaguggcaguaaagauucaaaugcccaggacaacguggagcuuuucagggagcaucuuuccauucauuuagggaguauuuauugaguaccuaguauguguuuagcacuuugauaagacuugaaaaugucaguucaacaaaaauacacuuggacugaacucaacuccuuuuaagaaaaauugacaugcuucucaccaagcagaaggccucaguugcagacagggaccaauacguuccugaugguuucucuccaacuggcucugucuccucaguuugcaucucugguaggcgcaggugugaugcugcuccugauggugaagaugggacacuuuuucuacacacugccaaaugcugugcuggcugguauuauucugagcaacgucauucccuaccuugaaaccauuucuaaccuacccagccuguggaggcaggaccaauaugacugugcucuuuggaugaugacauucucaucuucaauuuuccugggacuggacauuggacuaauuaucucaguaguuucugcuuucuucaucaccacuguucguucacacagguacuuugucucagguaauaggagguuaacaaggcaagguaagccaacucugaccuaaaggcaagugcauuuccuuucagagcuaagauucuucuccugggucaaaucccuaacaccaacauuuauagaagcaucaaugauuaucgggagguaagaauccaaaugggucccauuucucugccuaagggauagagugggccccaccucaugcuuaguuuuucuacaaaaucccuugccauuguuuccugcacugcagauacacauuuacaaaggagggggaugugauguacacugguagagauggguucuuuguuuuuauuuuuuuuuuuggagacagagucuugcucugucacccaagcuggacaguacagugcaguggcuugaucuuggcuuacugcaaccuccaccugccagguucaagcaauucuccugccucagccuccccaguagcugggauuacaggcgugccccaucauaccuggcuaauuuuuuguauuuuaguaaagacagggucucaccauguugcccaggcuggucuuggacuccugagcucagucaaucugcuugccucagccuucuagagugcuaggauuacaggcaugacucaacacacccagccaagacggguucuuaaguagcuaaauucuuauaguauugcagccaguuaaagaucauuuguaaauguacuuuaaggagaguuuggccaagaaaaaggaaaugaagggagaaagaagacagcaggaaaagcagagggugaaaaugggaggaaauaauuuucuaguucuugucucuaauaaagaagaauacaggcuggguguguuggcucacaccuguaauuccagcacuuugggaggccaggcauuugagaccagcguggccaacauggugaaaccccguaucuacuaaaaauacaaaaauuagcagggcgugauggcaggugccuguaaucccagcuacucaagaggcugaggcaggagaauugcuugaacccgagaggcggagguugcagugagccaagaucgcgccauugcacuccagccugggcaacagagugagacucugucucaucaucaccauuccuggggugaaaaucuuccagugcugcagcucaauuacauuuguaaauguuuacuaccuaaagcauaagcuguuaaaagagguugauaugguaaaggugccucuuaaagaagaagaaauuuucagcuuguuuaauucaagugacaccaaucuacaaggaggaaagauuugcagguguuucugcaacugugaugaucuggagccgcugcccaggauucuuuacacagagcgauuugaaaauaaacuggaucccgaagcauccuccauuaaccugauucacugcucacauuuugagagcaugaacacaagccaaacugcauccgaagaccaagugccauacacaguaucguccgugucucagaaaaaucaagggcaacaguaugaggagguggaggaaguuuggcuuccuaauaacucaucaagaaacagcucaccaggacugccugauguggcggaaagccaggggaggagaucacucaucccuuacucagaugcgucucuacugcccaguguccacaccaucauccuggauuucuccaugguacacuacguggauucacggggguuagucguauuaagacagguaaguacugaggaggccuuggcaggagcucugaucccccuccuaccaucccaaccccacccugauccugauugaauucuguuagucacugaucagcugcuaugagacugcuaggccaccagagccuuggacaccaaaggcaguacaauauaaggucaaucaaaauaaaaagagaaugaaccaauucuuuuuucuuuuuucuuuuuugagauggagccucacucuguugcccaggcuggagugcaguggcacaaucuuggcucacugcaaccuccaccucccagguucaagagauucuccugccucagccuccugaauagcuggaacuacagauaugcaaugccuuucaaaacgccaacauuuugauacucauugcagggugucacucuuccauagucagggcauuugagaggaaugauuucuuugacgcuggcaucaccaagacccagcuguuccucagcguucacgacgccgugcuguuugccuugucaaggaaggucauaggcuccucugaguuaagcaucgaugaauccgagacagugauacgggaaaccuacucagaaacagacaagaaugacaauucaagauauaaaaugagcagcaguuuucuaggaagccaaaaaaauguaaguccaggcuucaucaagauccaacagccuguagaagaggagucggaguuggauuuggagcuggaaucagaacaagaggcugggcugggucuggaccuagaccuggaucgggagcuggagccugaaauggagcccaaggcugagaccgagaccaagacccagaccgagauggagccccagccugagacugagccugagauggagcccaaccccaaaucuaggccaagagcucacacuuuuccucagcagcguuacuggccuauguaucauccgucuauggcuuccacccagucucagacucagacucggacauggucaguggagaggagacgccauccuauggauucauacucaccagagggcaacagcaaugaagaugucuaggagaugaacuagaaauaaggggucagauaaugcuggcaaauccuccuacccaaaaaggggucaauuguccagagaccuagacuggauacgaacuagcaguacuuccuuccugacugugacuccuacuaccugccagccuucuuccuugcucugcgcugggaucauacucccaaaucacauuacuaaaugccaacaauuaucucugaauucccuauccaggcuccccucauuucaccuucagcauauauucuagucaugaauuuccuucuucacacaccccacaucucugggcuuugugccagaccaucucuaacuuaauccucucaucccuguuccccuuucuccaaagagaugaagcucaaauaaaauguauaacucuaguaaca

SEQ ID NO: 1288 - RNA, 1326 nt, Homo Sapiens
ugcaucagugcccaggcaagcccaggaguugacauuucucugcccagccaugggccucacccugcucuugcugcugcuccugggacuagaaggucagggcauaguuggcagccucccugaggugcugcaggcacccgugggaagcuccauucuggugcagugccacuacaggcuccaggaugucaaagcucagaagguguggugccgguucuugccggaggggugccagccccugguguccucagcuguggaucgcagagcuccagcgggcaggcguacguuucucacagaccugggugggggccugcugcagguggaaaugguuacccugcaggaagaggaugcuggcgaguauggcugcaugguggauggggccagggggccccagauuuugcacagagucucucugaacauacugcccccagaggaagaagaagagacccauaagauuggcagucuggcugagaacgcauucucagacccugcaggcagugccaacccuuuggaacccagccaggaugagaagagcauccccuugaucuggggugcugugcuccugguaggucugcugguggcagcgguggugcuguuugcugugauggccaagaggaaacaagggaacaggcuuggugucuguggccgauuccugagcagcagaguuucaggcaugaaucccuccucagugguccaccacgucagugacucuggaccggcugcugaauugccuuuggauguaccacacauuaggcuugacucaccaccuucauuugacaauaccaccuacaccagccuaccucuugauuccccaucaggaaaaccuucacucccagcuccauccucauugcccccucuaccuccuaagguccuggucugcuccaagccugugacauaugccacaguaaucuucccgggagggaacaaggguggagggaccucgugugggccagcccagaauccaccuaacaaucagacuccauccagcuaagcugcucaucacacuuuaaacucaugaggaccaucccuagggguucugugcauccauccagccagcucaugcccuaggauccuuaggauaucugagcaaccagggacuuuaagaucuaauccaauguccuaacuuuacuagggaaagugacgcucagacaugacugagaugucuuggggaagaccucccugcacccaacucccccacugguucuucuaccauuacacacugggcuaaauaaacccuaauaaugaugugcaaacucuuaauggcugaaugggaaaggaaacugcccaaguuugacuaauugcuuggccugugaauggaaaagacucuggucu

SEQ ID NO: 1289 - RNA, 1054 nt, Homo Sapiens
gggcagcgccugacaugccugauccucucuuuucugcaguucaagggaaagacgagaucuugcacaaggcacucugcuucugcccuuggcuggggaaggguggcauggagccucuccggcugcucaucuuacucuuugucacagagcuguccggagcccacaacaccacaguguuccagggcguggcgggccagucccugcaggugucuugccccuaugacuccaugaagcacugggggaggcgcaaggccuggugccgccagcugggagagaagggcccaugccagcguguggucagcacgcacaacuuguggcugcuguccuuccugaggagguggaaugggagcacagccaucacagacgauacccuggguggcacucucaccauuacgcugcggaaucuacaaccccaugaugcgggucucuaccagugccagagccuccauggcagugaggcugacacccucaggaagguccugguggaggugcuggcagacccccuggaucaccgggaugcuggagaucucugguuccccggggagucugagagcuucgaggaugcccauguggagcacagcaucuccaggagccucuuggaaggagaaauccccuucccacccacuuccauccuucuccuccuggccugcaucuuucucaucaagauucuagcagccagcgcccucugggcugcagccuggcauggacagaagccagggacacauccacccagugaacuggacuguggccaugacccaggguaucagcuccaaacucugccagggcugagagacacgugaaggaagaugaugggaggaaaagcccaggagaagucccaccagggaccagcccagccugcauacuugccacuuggccaccaggacuccuuguucugcucuggcaagagacuacucugccugaacacugcuucuccuggacccuggaagcagggacugguugagggaguggggaggugguaagaacaccugacaacuucugaauauuggacauuuuaaacacuuacaaauaaauccaagacugucauauuuagcuggau

SEQ ID NO: 1290 - RNA, 1101 nt, Homo Sapiens
gugaaaguggaaaagaaacagugggaggaaugagaggcaagaagcagcggguagcacuuuucucgguaucaaagagacgugaaacuaggcuacuuaauuuuuuuucuuguaaaaaaagaacuuccaguuucccaagacgcaacauugaauucaaucagagguaaagauucuggacuauuggauuaaaugaggaggcaggagcuacuaucucuugcagugugaaaccagggccggggaugaagauauggacacaucucagcuuuccagggaugcugugaugugggugagcaugagcuuugucuaugggcugaauugcaucccuccaaaauucauauguuaugguccuaaccccuaguaccuccgaaugcgacuguuuggagauagggucuuuagagauguuauuaaauuaaaaugagguuauuagaguggcuccuaauccaauaugauugguauccuuauaaguagaggaaauuugcacauggcuggguacagagaaaagucuauguaaagacucagggagaagaccaucuaaagccaagaagaaagccuucagaaggaaccaacccugcugacaccuuaaacuuggccuucuagccucuagacugugagaaaauaaauuuuuguuguuuaaggcaucuaguacuuuguuauagcagcuugagcaaacuaauacaaguuccauuuguaguagaagcuauuaaacaucauuacauagucuaugucugcacucaacaaagacugguucccaccauuaagacaagcugcuccuucuaccacuugggaggaaaucagcuuaaggaaagguguuagaaauauuaggaaauacagauuaaaaaaugaagaaacaaaauauaacugugaucucaccacucaaagaaaggauguacccauuuauauucagcaagccuauuuugagugcaacauaaagcccugucacugguaacucuugacucagcugcucaagggcuuucagccaaaauccuaggaggagagugaggaaacuagaggacacugaaaagcugugccacaagugacucagauccugcaaguggcucgauggaggagugucccguguugguggcggagguuuuuccuuccuua

SEQ ID NO: 1291 - RNA, 9789 nt, Homo Sapiens
gucaacaauguagcgauugagagugugggcguuccggggagagcgcaagccgcgcggcgcggagcaaacagcgccgagccgccgccgccucagcagcagcagcagcagcagcagcggcagcagcggccgugcacgcccgggcugcggucgcacagcgcuaacgugagcggccgccgcccucgccaccccgccugcccacucccgccgccgccccgcucucgcuuuccccccggccuccccucgccccuuccccucccccuucccggcgcacucggggggcugggaacgagcugccaugugaugcgcguccccuccgcgagcuuucggugacccacgaacugcccaccucgccggcugccgggagggggcugcgagccgggaagacgcggggaagaggaggcggaaaaggacgcaaaguucuccggcgagcgcguucguucacauagcucccaguuuuaacauuucgccaccuacugaagacaucauuugggaccaagcugaugagcccuugaagcacagcagauaagaguguugcuguugaucaucuuugccugggaaguugaaugauaaagccagaagaaagcaugcuuucugaucauuccaaacaaagaccacacuguugacagcguuggguuccaguagcgguaaacuaccaaggggcugguuuacagaaaaugaguuugcucugugaugucauacaaguuugcuuuguccugacgccaacaugacacugaggcagcagaggagggagaacaggaaaauuggaaccguacucuuaguuaaugguuuccagagauuauuuagcaggacuugaacagagggaggaaaauauugugaaggauugcugcgagguguaccauaauugcgugcagcugucugcuucagaaagugagggcuccaggaaugaggagaaucuucaagaacuuccucgcacugugacaugucugaucccuugcucccaucccugcagcaugaacaagagaaaccgcuccugccucaacuccaagggccagagcgaguuggcacacccuccaagaggagcaccucgcuucuguggacacucacugaccugucacaagguugccccacaaaacuuugggguccaugucugaauggauugccagagccuucucaucucucccuucgcccaguucccugcauccuaagacucgaaggcagcacaggaccuggaaaaauuacauggugugaacggcaugucuguggaugagaagccugacucccccauguauguguaugaguccacaguccacugcaccaacauccuccugggccucaaugaccagcggaaaaaggauauucucugugacgugacuuugaucguggagaggaaggaguuccgggcccaccgggcugugcuggccgcaugcagugaauauuuuuggcaggcgcugguuggacagacaaaaaaugauuugguggucagcuugccugaggagaugguguaaggaucacuagauuucccuugagaguaaaagaucgaaagcauucacagcaccuucuuugcuugggggaaaaauaaaagcaacuaguaauuuucaccauuaauucaguaagauucuaagaaguguaaacuugcuuuucucaccguuguugaaaacagcccacgucacagccaggggcuuugggccgcuguuacaguuugccuacacugccaagcuguuacucagcagagaaaacauccgcgaggucauccgcugugcugaguuccugcgcaugcacaaccuggaggacuccugcuucagcuuccugcagacccagcuccugaacagugaggauggccuguuugugugccggaaggaugcugcgugccagcgcccacacgaggacugcgagaacucugcaggagaggaggaggaugaagaggaggagacgauggauucagagacggccaagauggcuugccccagggaccagaugcuuccagagcccaucagcuuugaggccgccgccauccccguagcagagaaggaagaagcccugcugcccgagccugacgugcccacagacaccaaggagagcucagaaaaggacgcguuaacgcaguaccccagauacaagaaauaccagcuugcauguaccaagaaugucuauaaugcaucaucacacaguaccucagguuuugcaagcacauuccgggaagauaacucuagcaacagccucaagccggggcuugccagggggcagauuaaaagugagccgcccagugaagagaaugaggaagagagcaucacgcucugccugucuggagaugagccugacgccaaggacagagcgggggaugucgagauggaccggaaacagcccagcccugccccuacccccacggccccagcuggggccgccugccuggagagauccaggagcguggccucgcccuccugcuuaaggucucuguucagcauaacgaaaaguguggagcugucuggccugcccaguacaucucagcagcacuuugccaggaguccagccugcccuuuugacaaggggaucacucagggugaccuuaaaacugacuacaccccuuucacagggaauuauggacagccccacgugggccagaaggagguguccaacuucaccauggggucgccccucagggggccuggguuggaggcucucuguaaacaggagggagagcuggaccggaggagcgugaucuucuccuccagcgcuugugaccaagugagcaccucggugcauucuuauucuggggugagcaguuuggacaaagaccucucugagccggugccaaagggucugugggugggagccggccagucccuccccagcucgcaggccuacucccacggugggcugauggccgaccacuugccaggaaggaugcggcccaacaccagcugcccgguaccaaucaaagucugcccucgcucaccccccuuggagaccaggaccaggacuuccagcuccugcucuuccuauuccuacgcggaggacgggagcgggggcucacccugcagccucccucucugugaguucuccuccucgcccuguucccagggagccagauuccuugccacagaacaucaggaaccaggccugaugggagauggaauguacaaccaagugcggccccaaauuaaaugugagcagucuuauggaaccaacuccagugacgaauccggaucguucucggaagcagacagugagucguguccugugcaggacaggggccaggagguaaaacuuccuuuuccuguagaucaaaucacagaucuuccaaggaacgauuuccagaugaugauuaaaaugcacaagcuaaccucagaacaguuagaguuuauucaugauguccgacggcgcagcaagaaccgcaucgcggcccagcgcugccgcaaaaggaaacuggacuguauucagaauuuagaaugugaaauccgcaaauuggugugugagaaagagaaacuguugucagagaggaaucaacugaaagcaugcaugggggaacuguuggacaacuucuccugccuuucccaggaaguuugccgagacauccagagccccgagcagauccaggcccugcaucgguauugcccuguccucagacccauggacuugcccacggccuccaguauuaacccugcgcccuugggugcugagcagaacauugcggccucccaaugcgcagugggggaaaacgugcccugcugcuuggagccaggcgcggcuccccccggaccccccugggcacccagcaacaccuccgagaauuguaccucugggaggagacuagaaggcacugacccgggaaccuucucagagagaggaccuccucuugaacccaggagccaaacagugaccguggacuucugccaggaaaugacugauaaguguacaacugacgaacagcccaggaaagauuauaccuagugacucggcucugccucccaguccgcacaccucucccauccaggcguucuucagucagccuguggcacuguucaucugcugucccgaagaaaccgagaacacauuuggugcacacuacagcggucuuagcagcaauacuguuccgaaguauccucuccucuucucgagcaggagugauaguuaccuucacaauggugcuaccccuugcccaggcaaggaaagacagcagugaugacacugucugucuguggcucaauuucagucuucacagggauagacuacaacaccucuaggccccaaccacggauuuuuuuucucaguggcccaugucacaaacccuaucucaggaauuucuucugaauguucaauuuuuuucauugaagacagcuucuauacacaucaaaguuuuauagcuagacuguacauauuauauauaauauauauauaaaauauauauauauauauauauauauccauaugcaaaaguccugcaugccucaacuuucucauccuaaaacuggaaacuuauuucucauuuagaaacagguuccaacauuccucuucuuuugucucugaugcuagaacuaguuugguaacuguuaacauggucauuuuucuugcuucacaguucaauuuucaauucguacuuauuuauggacaaaauucaguguuggaagcuuuuucccaagguuuuauuucagauuucuuuuucguuugguuugguuuuggcaccuccaaguggugucauuugagcauuguagguuuguuuuuuguuuguuugggggguuuuguuuguuuuuguuuuuguuuuuguuuuccuugcagauacuguacaguaauggucaacuuugccacuugcacugaguuuugggucaaaccuauuuucuuaaaugaaguuguaacuucgguauaacucaaguauacuguauauucuuugcuuuuaguuaaaaaaguaaaacauuuuagcuaauuaaaaagcacucaggugauaauuauguaggaaaaacaaucuugccaaauaaugaauucauccuaggauguguagacaauaaucugcuugaauauuuuuauauuucaccuccuccccaccuuucccuaagcaaaguuuaaacgcagauagagaguucagaguugaugcuggauguucagauuccuaaguggggagagaguuuggacaucucacucaaaaguacaucagaaaaacaggaauccgugauuuuauaccagaacucagcaggcauuggcuccuagaaaucaaguuagaaaguuuucacccagggaguaagucccauucauuucaacacguccugaggccucggcuugcucuuggaaguguugugcaguaggaccugcuccccugaaggacggggccaaccagccacuggcuuuccugcccaggcuuggccucccaggacaucuggccugaggggauuugaaucacagccccgaagguccugccuucaccccauugggagagagcagggcauccuggcaucugcgauccaucccugacacaggcugacacauucuuucuccuuuccuucuccaaaggcuuggaguuuucuucugagguuuuucugccagugucuugucugaaggcagacuucauucugaggcuuuggacaagcuaucaccgggaacccucccuguccccuucccgaaucacacacauacccuacccucaccugaugauaauuuucucuucuugcugcaaaacugguuggcuugcaacccagagagagcagcuucccuuggcucuggggccguguuggccccagccacguuuacaggaaggugugccccagaggaggaggaaucagcucccucgcuccaguggccuuggguccgggucucacugagcagcccgagggccacuccagcccggcuggggaagagaguccugaacgguuugauguggggaugggguggugggcaguggggaauagaugguugacuuuguuucuuuauuugugccauuguuuggacaauauuaaagcugcauguaaaaggggaaauuaguauaugauguaggcuaaaagugaaaucauaguaacauauguuuuaguauuauuaacuuuuuucuguacaaauauuagcacuaaauguuuaaauauguaugaaugccagaaauuugucaguucaugcaguaggauaaaaaaaaaaaaaaaaaaaaaaaaaaggcuuuucuuuuuaaacaguuccacuuuuaaaaccugccucuggguuuuuguuuuuucuuguuugugugugugugugugugugugugugugugugugugugugugugugugugucugaaacagaucuugauaaagcucuguguuggagcugcugguuuuuguuaugguuguuggaauuucuuggccuacuaggacaguucugugcuucaccaugagguuugccuuuguggaaaacuggugacagugagaauauaaacucaaugugaaucacgugauacuucgcaggcguguguuacaguggagucagcugacaguauuuugcuuuuuaacucuauuguugccuuuccaagugaccucuccucuucuuuuaaaaaaagaacacuuucugcucauaucauaaccagguccaacccagcuucuuggcaugagguuuacccugguaacaacucaugugcaacugguagucuugaccacauuccauccauuuccucagguuucugugguucaguagcccagaccuguuuggcagccauuucuagcaggggcggggccucuuuauuucucuccacccuaacucagaccucaccuuccucccacccaccccugccuugcuuuucuuccucuucccccaaccuaacuucugccaugggaacugguuaaaaacacugcucuaaaaaccaucuuccaauuucauagagauuucucacaaguuauuucauucauaauccaccaugaacagugacuagcuucgugcaguuguucaugugaugugugugugucuuuuccuauucagaacuaugugcuugucaaaauuauuucuggguugauucaaagggaggacuugcuggggaccagaauccaaacggccucaaguggaauuuuaaaaccuagccugucucuuuucccugggaucccucugucaaccccacgccuuuuaggaaaaagaaaagugagugaacagcaaggaagaguguuugcacaguacaguaacauuugguuguucuuaaggcucuuuucuuacaaaaauaagagacccuccaaccacgggcuguuuaggaggaugccugcuugggucuccaaauggcugggguaggaaugguuguuggggcagagccaguggaggugagugacccugagacuaaugaacaucccaccuaaauccaguccuccccuuggaucugccuuuguccugcuuguguauccaggcaaccucuuuucaaguuggucaggcuuuggacaggugagugauuugcuguauguguuuguuucucugcguuaccugggggugccuugauuaaaaucgaacuuuauuacauacugauucuggaacaaaacaguuagaaaaacuuuaaaaaaaaaaaaaccgacaaaguuacgaggccauccugcuauuuaucuucugaguucccagcaaugacucaggcaucagagaugaugcugcaguggaaaaccugacucugugugucugcaacugaauguugugcgaguaauuuauuaacugucuuucuaaagguuugcugcuuuuaagaugcacuauaauucgggauguaauccuuacauugcuuuuccaaggaagggaacaaaagucuagugauuaguaugccaacugccacuacuccuucaaaaggagccaggaccagcgacaagacucaugagaggacuggcuaaagugaagugugcacagugugaaguuuaaugcuguugucaagaggccuaaacccacauuuucucuuuuaauauuuuaugauugccaucaaagaagaagaaaaagaaggaacagacaaagguuugaaaaugauaagccuguuaagacaccaaaaacuccugucccgugaagcugcuugacauccuguggaguagcauaauccucucaaaaugaggaagagcugccugcaaagcuuucucaagucccuauuuggcuaccuacuucucuacauuaugccccauuuaaacuaggagcugucuuagaaaugacuucaaacugcuucacuauugcuuacaguuuaggaggagucucagauccagaaggagcaagaaucaaguuugguccucaaaugacuguaaauagacuaaagaacaagguguuuuuuguuuuuguuuuuguuuucuaagaauaaagcuguucguuguaucaugaguuaguguuucuuccccaaacugaagacuguguuggaagugcaauuucuggugagucaguccacaauacaaugcccuguguggaguugguauucauacaggaaaucugugugcacgaggcauuguguguugaaaguguauguuuauaguacugccugagccaucucaugaccccagcguccaaaaccgaugcuguagaacagaacauaucuguacacaaauagugugugcaaauagcauuuguacauagaaaagucucauuguggcagauugagcauaaauuauucaacugacggugcaaaaacauuacuugcaaagaaaaguuuauaguauuuuccuacacuccacccugggagaugauauuucuaucaaaugaauaucagugcauuuuaaauguaauaugaaaacgaugcugccauuuugugaagaauacccacuugguugcagaggccaacuuucauagcuuugauuuaauguugugacacgguguaugcauuuugcugucaagcaauggauaaacagcucugacuuucauucucauuccaguuuauugaccucagauaaaacacuggcccuucuuagaagcagaagugugcaccaagaccauucauuucagguagacucacauucagugccaagugcucccaugggaauaaucagacgcauauguugcgaaagagugaagggacuuggacaaagagggguuuuccuacagauggaugcucagucuucuaccaaaacauguuuggaggcagaacuaugaccuccccuuaaguccuaacaauguauuuugugugugcaaauccugggaugcccguuucacgcucugacauaaagacauggcaccucuagugagugaucaggaagauuccauaugcauuugggagcuucaggugcuuguuagacacagugagccauucaaggcaagcaccaccuuugcuagugaggccaagagagccugugacaauuugacaauuuguuccagaaccagucugaugcaagugcaccucuaauauaugccuuacaaacuccagaggccauauucaaaacagggucuucucaguguaugcaaggggcugcagccccucuucucuuccuccccagguugaacaauacggacaguuuucacacauaucuaccuguauaacccucuguaccucucauaacuggucaacgacuguaacagguuacaucagguguuuuucuacauacuuuuuacacagauucuaugcgauuaauguaauuuaauucaaugcaucauuuuauuguacuaguucuuaggcuuguccuuauuuuuuucuaagugauugugguuuuucucgugguuuuuauuguaaaaaaugaaaggcuguugaugcuuauucucuguaacuaagaauuuuuaccuuuugggggaaaaaagcauugcuaugaacuaaugaauugaaacuucauuuacucauuguaaauacacuauugugcaaaaaaaguuuucacucaauugaauugcuaguguuaacugaauuuugucuagacaccauuucuguugaugaaauaaagacauaucauuaugcauuguaaacuga

SEQ ID NO: 1292 - RNA, 2383 nt, Homo Sapiens
gcaccccacgcuccuagaaaagagcacgacgcacccgaugcucggauuggaugaaguggcaaagguaaccccgcugguucgggcguuuggcuguuccugugccuggacccccgcuuuggaaauggagguggggcuggcucccaaccugucucagagacccucgcacuccucccccaccuuccgucagcugggacccgcugagagccguuuuuggucacgcgcgcuuagcggauagaccugcagucccgcagagaggaagggcgcccgggcuguccgccgcgcggggaggacgcgagcacccagcuuuaaucccuggaaaguccacgaacaaugaauccauuucaugcaucuuguuggaacaccucugccgaacuuuuaaacaaauccuggaauaaagaguuugcuuaucaaacugccagugugguagauacagucauccucccuuccaugauugggauuaucuguucaacagggcugguuggcaacauccucauuguauucacuauaauaagauccaggaaaaaaacagucccugacaucuauaucugcaaccuggcuguggcugauuugguccacauaguuggaaugccuuuucuuauucaccaaugggcccgagggggagaguggguguuuggggggccucucugcaccaucaucacaucccuggauacuuguaaccaauuugccuguagugccaucaugacuguaaugaguguggacagguacuuugcccucguccaaccauuucgacugacacguuggagaacaagguacaagaccauccggaucaauuugggccuuugggcagcuuccuuuauccuggcauugccugucugggucuacucgaaggucaucaaauuuaaagacgguguugagaguugugcuuuugauuugacauccccugacgauguacucugguauacacuuuauuugacgauaacaacuuuuuuuuucccucuacccuugauuuuggugugcuauauuuuaauuuuaugcuauacuugggagauguaucaacagaauaaggaugccagaugcugcaaucccaguguaccaaaacagagagugaugaaguugacaaagauggugcuggugcuggugguagucuuuauccugagugcugccccuuaucaugugauacaacuggugaacuuacagauggaacagcccacacuggccuucuauguggguuauuaccucuccaucugucucagcuaugccagcagcagcauuaacccuuuucucuacauccugcugaguggaaauuuccagaaacgucugccucaaauccaaagaagagcgacugagaaggaaaucaacaauaugggaaacacucugaaaucacacuuuuaggaaaguacauggaucaccaugagucuagacaugauugucuaucuuacugguauuaucagaaagggcagguguaccgauauguuuaugcccauucuucuuguguacuugugacucuuagcagcauggaagagaaguguaaccaugcaaauacaaugagcuuaauaugcuaacuuuagcaagauguaaaauguugaucuauauuguggguagggaaugggauagucugagauacccaggcuucaugaugguguauauuauuucagcauauuauaaacuagucacuaaugaaaauggccauccaugaccauugacucaaaacucaccaaggaaccugaccuugcccuccacacuguggccucacuguaacaguuuccucaagguuccuaggaggguaucaccuuagagugaagucuaaaauuuggcuauuuuuuaucuauaaaaaaugucaguuuuauaugguccaauacuaauacccucaacaacuaagccccaccuuuuagaauaaguuaccauuuauugcacacaugcaauguguaagauuacauguaacaaaccugugaaauaaguauuauuaccuuuguuugcuaaggcucagaaaggagaaaugauaggccuaaugcugcaacagcuaucuaagagcugagcuaacauucagcucugccuguuucuuuucuacugcacgaccuugacaaccuuuacuuaucauacuggagaacccaguaacuuggaguuucuuuugcuuucuccuguagcccuacaagaggagaacuaaagucugauagaaaugaguugauguuuuaagcaucauuuuggauuaucuuuguucucacaccugcuaacuguagaaacuggcaucugcacuuuaauaauaauacuuuacuucuggacuuuaagcauaauuaggaaacauuccuggccgggugcaguggcucaugccuguaaucccagcacuuugggagguggaggcagguggaucacaaagucagaaguucaagaccagucuggccaacauagugagacccugucuacu

SEQ ID NO: 1293 - RNA, 2615 nt, Homo Sapiens
agaguugaggccaauggcggcuccaccauccuguggcuaugauuccugaacuuguggucuccucaguugaugaggugaagaaagaaagccuggagaauuaugcacgagcuucucacugucucagcccacaaguaacacaccucuuucccucacagcccacacuggcuggaaccaaucacauagcccugccuaacugcaagggaggccagaaagugcaacacuuucucauggucacgggugagcacgaaacaucucuccaaauauggguugggaagauuaagagacuaguccagaagaaaacagucuccagggagaaauauaucugggaauaggaaucgagaaagcaaccaagagagcagaacugaguggaugagaggaacugucagaccacaucugcagcucugauuagucaaauccgaaaugugccuguugaucuacuauuccguggaaauacuggaaucaccagcucaauaauaagagggguuuugaagaaugagcagaagcucugcgucagaugaagaagagacaggaggcccuccaagcaaaggaaccacucaugucaagacauggggcaaaaagagaggauguauuuggagaacagagaguaaccgaaggcuaucauucaaucagugauagucuucauggagguuaauaucaaaggcaaccugaauuuccucagacuucaugagcuggcggugaagggugagaucacacaagcaguaauaacccagcucucccuggcucacugccuuacuuacuggccuucugguacucagcaaagcuguccccaugaguuugggagucuccauuccuguccuuccacuccccucaaacgucuuucauucaaggucacgugguaacuugacuccucucaccacuacuucugugggaaugcagaggccaggccagagccugugggugcugcccuccccagagacuucacuaugcccagcuccagggaggacugacuggaggaggggaccaggcaucuccccugcacucugggcccacagcaacccuguauaccagcccguauuaaccuugcaacgccuuccuccaaaaggcugagacuucaaccacaggaccuggguggugaucaccacaaaauuucuuccugaacguucuucuccaacaacuucucacauucaguuauucauucaacaaacauugagcaacaaccuaaucuucugggcucuggagaccgaguuaaaaaggagacagcaggccccugcccccgcuucccgacaggucaccacaucuugagugcuaagacugucaucacagggugaggaggggaaaugagcucagaggggcagaaccuucugaaagggcagaaugguucaagcaucccgccaaggucagaaggcgcuggauccagggcaaaaaugaagacauaagggaccuuaggugacaaggaagaagcucccaggcagcaugugggauggacccaaggagaacgucagagagaaagaguucagucuggugucuccugaagcagguggcagcaugcugacgaaggagggugggguacgcaaggaacugguugccucuaggacucgcgacaagaccuuacggagaaagaagucagccaaggaaaaacgacuggaguguggaagagucuggaagagcuggaccagguccacaugguccggucaguucucgaaaaaucgagacccuguguggugagggugagccaucuuagcaggaagguuaaaauuaagcucggcaggcucgacguaaaugugcagacaaagcaaagcaggaagccucccacacuaaaaagggaagauaagaaucacagaagcugggaugguuuuuauugaagggcauuucaaagcaaauacagacaucuacagcauauuuguaaauccuccguauguguauggaaacacacaccuucacacaucaaaacuggauuuguuccugaguaacaaaacguccuaagaacaaaaugaaagaaaaccaaauagcagaaaaauacuuccaauguauauaccacaaaggauuauuuaucaacucaacacaccaagaguuaagaaaauaaugcaacaggaacaaagggcaaaggauauguacugggaagaccacagagaaagaaaaugcaaauggcuaauaauauaaaauauuuccuagguucaauaguaaucagggaaagacaaaauuacacuuuugaccucuuagacuggcagugacaaagauuauuugagugaccaagcuuuagucaggcuccuggaucuucuaggcccaucugggcacuuccucguaaaauacaguuuuaacaaaagcccugcuaaauugguuuaccgagaacucccacccucaaucgaguuccuuagcccuucaccuuuccucaggugagggcugaucauccuguccugucuucagcaagacugcucuaacgcugacguuuccuuuuaguaauuuuccauccacugacacccacuuguaauuuauagccaaggagcaagauacacugcuccuuggcuauaaguuauuuucccuguuacauucagaguugagcccaaucccacuccccgacuacaaaaucgauagcaguggucccuauaccuauugcaaugguccuaaauaaaaccugccuuaccgugcuugaacaa

SEQ ID NO: 1294 - RNA, 811 nt, Homo Sapiens
ccuccuugucagugcugauuucugcacccaucucccaguuaccaucuggaauagaauccaauagugauccaccaauggacaauuuuugcuaugaaggaggaaagagaggacagauuugauuacaacaaaagcaucccaagaauguguccugcaugagcucuucaggcugugaaaucuugaacuucuacacccauccuuggcuggcuuuuuccaugugaggccauauagaguaacuuaugagguauuaccaccgucauuuuccagaagaagaaagcugaggcucagagugaucaagaauacccagccagaacguggcaucugggacuucugucuccacucuguuauccaccagcacccuugggcccuauugcuuggcuagaugggcacucugcauguaucaggcauugucugucaccugagucacuacauguaugacaucauaugucuauuaccagucucagauauacacuaagaaaauaagauuucauuaaaguauuuucuaaauucauugcugcaggugauaagcauccugauggaacugagcuucacuaacaggaggacaacacugauugcaguaucagggaugauauaguuugagccggauuauagagcucaucaacugauccacaucuuaaaugcuccaucuuuggcauaagguguuuguaaauaauaugcagggcauuuauaaauaugaugggauacuuaauaccaaaauuaacuauaagugaauugcugggauagaauaaaauacagaaaacgaauacauaagaucaauauguuaccauaaaauuaaaauauuuaauagcuucaa

SEQ ID NO: 1295 - RNA, 741 nt, Homo Sapiens
ugcuuuugucaccugccggugcucaagaggcucucagcugaaagucaaggccagcugaaacucugaugcaugucucuguccuauuuccugggaaucaguuauauuaucuucuaucgaaauccuuuuguuugccuucuggaucaacuaauccugaaagucccaaaggaaaacuaaagagagaacaaaaacugcagaaaagugagaaacuugccaacuuagauuuuuuccccuaaacauucacucugcauuggccuggggaaaaggauuagucacgaacauguuuauuuuuuauuuuuaagacagggucuuucucuauugcccagacuggagggcaguggugugaucauaguccacugcaaccuugaacuccuaggaucaagggauccucccuccucagccuccugaguaacuugggucuauaggcaugcagcaccacacccaguuaauuuuguuuguuuguuuuuuguagagacagagucuugcuauguuucccaggcuggucuugaacucauggccagccacgaguaucaagugauacuccugccuuggccucccaaaaugcugggguuacaggcaugcgucauugcuccucaucuuuacugauaauuuuaaccucuucuuuccacauuugaguauuugaucaaccugguauuuauuuuggaaguaugcaucuacuuuaacuuuucaauaagaaaagccagcaucuuucuccuauaccaaguuucuaaauauacauauaug

SEQ ID NO: 1296 - RNA, 223 nt, Homo Sapiens; identical to SEQ ID NO: 1256

SEQ ID NO: 1297 - RNA, 1898 nt, Homo Sapiens
ucagucacugaauuucuccuuuugggagugacagacauucaagaacugcagccuuuucucuucguuguuuuccuuaccaucuacuucaucaguguggcugggaauggagccauucugaugauugucaucucugauccuagacuccauuccccuauguauuucuuccugggaaaccuguccugccuggacaucugcuacuccagcguaacacugccaaaaaugcugcagaacuuccucucugcacacaaacagaaauaagcaauuaaggaaguucuugucaucuuuugccugagcauguuuuaaaacuagagaaaugcucaccccucuaaauaguugaacuguuuaaugcuauaggagcuuaaaaagagaggaucuuucucauuuuuuuucuccuccuugaacacugugaaauuuaugguaaaaugacagaaaaagaagaaagacuaagugaaucugguaacuaaagaaagagcuggaaaaaagaaaacuagagggcaagaggugauaagagaggucaccucuuaucagacaggagacaaguugauggagaaaaagaucugcuaugagggaaaauucugucuccagcccugcaggaagaauuggaaaaucagaaaagagugaaaagggagcuagacugacuuaaucuucagcccagguaaaacuggaaagacaguuuaacauguucuuuagaaugauaggcacuaucaggaagagaugaagucagggauucaggcucagagagacaaauacucauccaggaucccaagagugagcaaggguggaauauggacuccaggcaaggcugccuaauuucaaaguccaugauauucuaauagaaagggagaucuagugcugcgaucagaugcagagagaggucaucuuugcccauuucacgauuccauaguugugauuuuuccuugccauuucuuuugucuuccagucaaagguaugcaggcaggaugagugcaaacaccuccauggugacugaguuucuucuucucggcuucucccaccuggccgaccuccagggcuugcucuucucugucuuucucacuaucuaccugcugaccguggcaggcaauuuccucauuguggugcuggucuccacugaugcugcccuccaguccccuauguacuucuuccugcgcacccucucggccuuggagauuggcuauacgucugucacggucccccugcuacuucaccaccuccuuacuggccggcgccacaucucucgcucuggaugugcucuccagauguucuucuuccucuucuuuggcgccacggagugcugccuccuggcagccauggccuaugaccgcuaugcagccaucugugaaccccuccgcuacccacugcugcugagccaccgggugugucuacagcuagcugggucggcgugggccuguggggugcugguggggcugggccacaccccuuucaucuucucuuugcccuucugcggccccaauaccaucccgcaguucuucugugagauccagccuguccugcagcugguauguggagacaccucgcuuaaugaacugcagauuauccuggcaacagcccuccucauccucugccccuuuggccucauccugggcuccuacgggcguauccucguuaccaucuuccggaucccaucuguugcgggccgccgcaaggccuucuccaccugcuccucccaccugaucguggucucccucuucuauggcaccgcacucuuuaucuauauucgcccuaaggccagcuacgauccggccacugacccucuggugucccucuucuaugcuguggucacccccauccucaaccccaucaucuacagccugcggaacacagaggucaaagcugcccuaaagagaaccauccagaaaacggugccuauggagauuuga

SEQ ID NO: 1298 - RNA, 920 nt, Homo Sapiens
gagaacuuggcaggcucuccccauggcagucuuauuccuccuccuguuccuauguggaacuccccaggcugcagacaacaugcaggccaucuauguggccuugggggaggcaguagagcugccaugucccucaccaccuacucuacauggggacgaacaccugucaugguucugcagcccugcagcaggcuccuucaccacccugguagcccaaguccaagugggcaggccagccccagacccuggaaaaccaggaagggaauccaggcucagacugcuggggaacuauucuuugugguuggagggauccaaagaggaagaugccgggcgguacuggugcgcugugcuaggucagcaccacaacuaccagaacuggaggguguacgacgucuuggugcucaaaggaucccaguuaucugcaagggcugcagauggaucccccugcaauguccuccugugcucugugguccccagcagacgcauggacucugugaccuggcaggaagggaagggucccgugaggggccguguucaguccuucuggggcagugaggcugcccugcucuugguguguccuggggaggggcuuucugagcccaggagccgaagaccaagaaucauccgcugccucaugacucacaacaaaggggucagcuuuagccuggcagccuccaucgaugcuucuccugcccucugugccccuuccacgggcugggacaugccuuggauucugaugcugcugcucacaaugggccagggaguugucauccuggcccucagcaucgugcucuggaggcagaggguccguggggcuccaggcagagaugccucgauuccucaguucaaacccgaaauccaggucuaugagaacauccauuuggcccgucuuggcccaccugcccacaagcccaggugauuuu

SEQ ID NO: 1299 - RNA, 223 nt, Homo Sapiens; identical to SEQ ID NO: 1256

SEQ ID NO: 1300 - RNA, 673 nt, Homo Sapiens
uaacucucacuuuguagugguauauuuaggauuugaugugacacaguuauuuauugcugagugagcaaaccccuagcccccaaguggggacuacaggcuucagugcuucccccacacugccugagcuaccagcccuucugcacuggcccuccugccaauacugccugcacuguccccacucccucuggcucccaugaucaccagauccgcccugcaggcucccugucaccuguggggcccuauccagacccccuaauccacuugccuagcagccccacucuucccucgauggcucagauccugagauccaaggaacacccuggguuucccaaccacucucuuacugcagagguccuaggugcuccuggaucguguagucuuuaacugcugucccaagggaccucaaggaauaggaauucucuuuguuaggagguggaaugaaaguguccagcaaacuccagccagcagcguucgucccuugauuuagagggcuaugauuucuacaaaguggcccgacuggcccgcgaacacgcagcagagacgcggccuccacaaggucagaacuaagauguccucagagauccccaguuacgaagcaaagcgcgggccuacuucgggaccuacgcguccgggcgcugugcgcggggaccgcucccgggcccagcgucggggc

SEQ ID NO: 1301 - RNA, 223 nt, Homo Sapiens; identical to SEQ ID NO: 1256

SEQ ID NO: 1302 - RNA, 1898 nt, Homo Sapiens; identical to SEQ ID NO: 1297

SEQ ID NO: 1303 - RNA, 5661 nt, Homo Sapiens
acauauaaacccacagccacugcggguggaaggagaagggcaggguggaaaaaguuugagagaaggagggaggaaaagguguccuggcuagcaccauguggauucucuugagaugagaagaaaaugccccgcuacgucccccuucugcugcuccugcuucuccugagguguucagaacgggguggaggaguuaauuuuggugagaaggaugcaaaaguccccgggaccuggagagauggagucagggucccuggagaaggagccucuugggacucagacagggccagucccgagcgaagguacggaauaggugagugaaccuugggaacuccggacccuguuaucuacccucaaucaccugccacagggaagcagggaccccagcgucuuucucauauccccuuuuaaggaaaugcucugcuuuugauuuugugcauuuuauuuaaguuucuuuguuucaacuuuccuggagaaaugaaaaauuuggcacuccucuaaucccagcgcuuugggaggaugagaaggagugggaucccuugagcccaggaguuugagacaagccugggcgacauagugagacaccaucucuacaaaaaccaaaaaaaucagccaggcgugguagcccaugccuguagucuaaucuacucgggaggcugaggugggaggaucacuugaggccaggaggccaaggcugcauugagccaugauugugcuacugaacucuagccugaaucacagaacaagacccugugucaaaagagagaaagaaaaagagaaagaaacggucaggugcaguggcucaugccuguaaucuuagcacuuugggaggcugaggcgggugggucaucugaggucagguguuugagaccagccuggccagcauggugaaacccagucucuaguaaaaauacaaaaauuagcugggucugguggcgcacgccuguaaucccaaauacuugagaagcugaggcaggagaaucgcuugaaccugggagguggagguugcagugaguggagaucgcgcuauugcauuccagccuggaugacagagggagacuccgucucaaagaaaaaaaaaaaaaagagagagagagagggaaaggaaggaaggaaggaaggaaggaagacuugaacccuauuagaaaaauguggagcgucagcaguagggagggaugacuagauuugggcagaguaccaaaaguucaaaauuuaugccauguaagcuacauguauuccuaagaauaagaauacucccaaguccugacggcugccuggggcagugagggcuggagacgaagaggacucaucucuucuuuguacuuauaccugacucaguguugcccucaguccaacuagaucacacccacaccccucaugacuccuccccuaagccugcccccauaccaccuugaaucuucccugccuccaagccuaccacguuagccccagaucugacccagaagcugucucaugcuuuuuuuuuccuuuuuugagauggagcaccuggccagcugucucauuuuaaaucauauaccaagcaugaccugaguguaaucucuaacaugaaucacagcuucugccucauugguuugccagaaccgcaggcacaaauggaugagaggagacaccuaugaacauggagccagaauaccccaauugcugaaacaccaguucagagaggagugagcuugagaaagagucagguuuagugucccacggaaagagaccagaccuggaaaagacagagucaaagcugggugagcaggccuucgaagggcguggcucagcaaagauaauccauauuguagugcaagaggauucuuguggaauauguuuuaccagaauuaaaccaaaaaugccaaaugaucccuaacuggaauaaaucucaccacauuaccuggggagaggugucauuuggaugugaggauaguuaugaaaauacugagcagagcagaugaggauaggccaucaacaauucacauuaaaugagauuacuuuuuaguaggacuaagccaaagcauuuccacuaagcacccagagaccagcccuaaagacucaagaauaagagaaaaugauguaacugcagauggaaggaccacugaggaccacaucacugcagacccagggaccaccgaggacucugucacugcagacccagggaccacugaggacaaugugacuguggacccagggaccaccgagggcucugucacugcagacccagcgaccaccaaggacuaugugucugcagacccagggaccaccaaggauucugucacugcagacccagggaccacucacugagaacuuugucacugcagacccagggaccaccaaggacuccaucacugcagacccaaggaccacagaggacuccgucacugcagacccagggaccaccaaacacuccaucacuguagacccagggaccacugaggacucugucacugcagacccagggaccaccaaacacuccaucacugcagacccagggaccaccgaggacuccgucacugcagacccagggaccacagaagaugaaaccacuaaacauggugacacucaccuucugugaacuacuucagucacagcagugaaacccaccaggcuccugacacccaugggaauuauccucauaucccuggcugcaaccacagucacuguugugcucuuuguuggauugggcuucauuguggugaguauuuggucugggaauauucagggcaucaggggaacgaggccaacugaggauaagcggugggcauggagagcugagguacagaggcccaagaaaucgucaggcgugaggaagccuacauagagagagcucugcaaagacuccuggaaagacagagguggagagaaaggaaaagagcaccuggcacaaaagaugcagaaagcauuggggacagaggaagcugugagagacaggaaggagagaaagggaagagaggcugagagugagaaacauaagaacacaaacaugguaagacacagcgggagucagggcaaagcaugaaccguuagguacagauggauguaaaagaggaaauuuuccuaagaagacaaggaacuggggaccagaggaguggaugaauuagaaacauucugggugguccacucauaucagaaauuacauauucuuguguuaauuacuaccuacucugaaguucugaagaagauuuuuuuaaaaccaaaauugaguggguuuuuaugagccaccacuacccugcaccaaagagacaguuuguaccagcucucaaagaggagcucuggguauuuuucugucucugagggucccuguuguuucuacaagaggagacaaaagaauuccaugccagcccugcauguuucaucucaccaaacucccagcuggaaucaucccaaaagcagcagcagggaaauucccacagggaguggcccaaacccuccagagauggggccaauugggauuccaaagaaagaagcccagaugucagggugaucaauucaaagcauuuauuaggggaacuuacagaggacugcagcaauccucccugccgacagggagggaaaagggauguucugccuaagcaugucuguagcaagggggucaggguauggaguuuauaugaggguuuagggaauuugacucagggcuggagccaguuucuuucaacguuuugggcaacaaccuagauaccuuuauuagugccugggaguguucaaggcccugguuugcguucaagccugcuggggaaaaccugcagcuggcugggucacagaacggucaaggcaaucugugauuuuuggucagucugaucagaaagaaaaggaggugaucugggggaccccacauuguggcuuccucucgcuaacauuugaucuaaaacccaagccuccugcuucuggccugcugcuugagggggaagggcugguccuuuuuggccauccugaccuacggauuaagugcaugucgaaauuuuaacaaguggcggcuugcaggauuagccaacucgggcaggucauuaaagccucguuaauucuugcggucauugaugccauugugcacugaccccugcuccaagaugcaaauccacagcuuuggaucaguuuguaagugugaguaaagccgaaaguaaugcaugauacagaugagguguucacauuuaauucugcuaaaaugacaccaugaaacuagagcauucugaaggaugcugacaagaggaaaauggaaugaaagcguccauauguaccugacucaugcaugagucauguucaguauucaccaguagagggaggaccuucuggacuucgcuguuaccauaaacaauuggauuucugaucauguggaucaccaugaaaaguuggacacucuugcucuagaacaaaagaugcuuuccuuccuccaaaccaggcauuggcccagagaggucacuagcauuagcaccuucuuaauuucauguagagacuaaaaacaagagauggcucaaaaggcucagggugugggaaguaagaggaaagucuaugcucccaaacuugcuaaauuuuugacuuuuaaaccuuuaacucgaaaaguuuuaaaaauaagaacuauauuaccauuccucccaaguuucauuugucaaaaugcuuuuuucuuuaaacuuuaaugguuuaaguuuuuuuuaaguuguuuuaaaaaaaacaaaaaagguuuaaguuuuuuuuggcagggugcgguggcucacgccuguaaucccagcacuuugggaggccgagguggguggaucacgaggucaggacuuuaaggccagccuggccaauauggugaaaccccaucucuacuaaaacuacaaaaaaguuagccagccauaguggugggcaccuguaaucccagcuacuugagagacugaggcagagaauugcuugaacccgggaggcagagguugcagugagcugagaucgugccauugcacuccagcgugggcaacagagcgagacuccaucuaaaaaaaaaaaaaaacaaaaggcuuuuuuuucccccuaaaugucguccacauuuuuggcaaguauugaucucuaguagucagugucaggaucugaagaaaacagugacaucuagcagacucccagagccagggaaacaggcugggcagaagugauaaauuacaaaccaccaggguuaagagaagaacagaguguuaaaaccaaaccauuuucuuccucccuagaaagaguguuuccugccuccauuaaauccauccaccaggguuauuuaucauccccaugucauggacuacaguacaccauaaagaggaccccagcagugacuacaguugguucuagaaaaaggagaccccucauccgccucugcaagacuaugcagcaugauguguauccucaggccuccacuccuccgcccuagucuggagcccugggaccaccacaugaggaaggcagcuggccccuggaauaagcauguggaggacacucagaaggaugcccaucugcucugagugucuccuaauucugccugaccuugguuacuuccucuggacaaucgccuuuaccuaucuaccagguuuugaggaauuacacacagcucagguauaagagauauucgguaagucugaucaaaucaauaaagcaaauuuuaucuguuuuugucugggacauaucucuacauucauucauuuaacc

SEQ ID NO: 1304 - RNA, 920 nt, Homo Sapiens; identical to SEQ ID NO: 1298

SEQ ID NO: 1305 - RNA, 223 nt, Homo Sapiens; identical to SEQ ID NO: 1256

SEQ ID NO: 1306 - RNA, 8903 nt, Homo Sapiens
aagagcaaaauaauaugaaaaguauuuaacaaggaauauaaagaaucaucaaagaaaauguuauaaaacuucuuugagaccacaagagaugauagagaugggguuucacuguguuagcgaggauggucuugaucuccugaccucgugauccgccugcuucugccucccaaagugcugggauuacagucgugagccaccgcgccuggccuccucauauuauuuuuuauugugcaguuuauucaagagagcuuuccagcaccugugauaagccucagcccgccugccggauaaugagcccacauggauugagagaggccuccuaucccugccaaaccuauugaugcuacagagaugugagggagcccaccugagaaaagcugaaccugcccaguacauaaaaaccacucagggcaggguuugguuugggugucuucagauuuccuugucuugaggcccucacaauugcucuacagcucagaacagcaacugcugaggcugccuugggaagaggaugauccuaaacaaagcucugaugcugggggcccucgcccugaccaccgugaugagcccuuguggaggugaagacauugugggauccaucucugacucccugcuccuuuauagagauggacagugaguuuguaaaacaaaaguugaaaagucagauaguuaaaaggggaagugaacuggaagguacucuaaacuuucacaaccuuauuaaccauggcugcucccauucugauuuuguucagcaguggaaguuucacccgcuccuccagagcgcuuggcuucuuuguuccaaauuuccuuucuucaaccucacaccagagugcccuggucaggcucagcucauccauuaggcacaaugugggcagugcaggggacccuccagacuguaaagccacaugagaauguuuuaacuccuuuuaaaauuauaaaaaaaugaaauuguagagccuaagaaaauguuuuaacuuuuaauucagccuagauuauauugucuuuauaccaauucagucauaaaauauaguuuuccauauuuuuauggaggaaggcguccacacaagcaagagugcuuggggcucacaugucagaacgcaacccugaucauggcugauccuggccuucgugugguucugcuaacuaugugccugucagucuuccccaaaaucuaugugguccucaaauauaacaacugucauucaauacacauguuugagcacccagugagcuaaguuuuaaggauucaaagaugaaaagucaugcugucuccucugcaaagggugcucagacuagugauggaaacaguaugggaugaaagaaagcagaaggccauugcugagcaggcaguggacucagcagaggcugaaacuauacaagugacuugguuccagcugggccagcaggauaaccagaugaaaagaaggauugcauauauuccauauauauuuauguuugaacaaagagucaagguuuauugcaaggauaaggagguuuuguugguggccuguuaagaccauccaggguggucauacuggauagggaagaagcugaccauguugccucuuacgguguaaacuuguaccagucuuauggucccucugggcaguacagccaugaauuugauggagacgaggaguucuauguggaccuggagaggaaggagacugucuggcaguugccucuguuccgcagauuuagaagauuugacccgcaauuugcacugacaaacaucgcugugcuaaaacauaacuugaacaucgugauuaaacgcuccaacucuaccgcugcuaccaauggagaggaaaugcugguaggaagacucuuccaggauguaaugcagaagaagcucagggcagagcuauucacacuuuacaccagugcuguuuccucaccauagagguuccugaggucacaguguuuuccaagucucccgugacacugggucagcccaacacccucaucugucuuguggacaacaucuuuccuccuguggucaacaucaccuggcugagcaaugggcacucagucacagaagguguuucugagaccagcuuccucuccaagagugaucauuccuucuucaagaucaguuaccucaccuuccucccuucugaugaugagauuuaugacugcaagguggagcacuggggccuggaugagccucuucugaaacacugggguaaggaugaguuucaccauuuuuugaugcuuucuugucugucaaguucagaacuuccugccuuuuacucuauaucccaaaacuuguuuuccacacuucaugaguuucuuuugucuuuuuuuugaaagaauuaagcaacaaaagcacagauuuauuaaaaaagaaaguacacuccacagggugggagcaggccugccacuucauggguuucuaauaacagacuucacucuccucccuaagcugggggccuugagucuuugcagagccaacccucuaccccaucccaucccacacacaugcacaugagcaaacucugcauucugaccucaacaacuucacuuccacagagccugagauuccaacaccuaugucagagcucacagagacuguggucugcgcccugggguugucugugggccucgugggcauugugguggggaccgucuugaucauccgaggccugcguucaguuggugcuuccagacaccaagggcccuugugaaucccauccugaaaaggaagguaagauugagauuuguuagagcugaagcugcaggaaggaaagugggaggaggcuguggacaugaaugugguugaaaguuguaggggaauugggaaguggcaugaugaugacacaggagcccccuuggacccaucgaucucaugucuguccuguugcaggugcaucaccaucuacagcagcggaagaguggacuugcuacaugaccuagcacuauucucuggcccgauuuaucauacccuuuuucuccugcaaauguuucuccucuuaccuuuucucugcuuuuuuuuucuuaagcuucuguauccccucagagcucacaaaugccuuugaauucuuucccugaccuccugauuuuuuuuucuuuucucagguguuaccuacuaagagaugccugggguaagccgcccagcuaccuaauuccucaguaacaucgaucuaaaaucuccauggaagcaauaaauucccuuuaagagaucuaugucaaauuuuucuaucuuucauccggggcugacugaaccuauggcuaagaauugugacacucucauguuucaagccaauuucaucucauuucccagaucauauuucauauccaguaacacagaagcaaccaaguacaauauagccugauaauauguugauuucuuagcugacauuaauauuucuuucuucuuuguguucucacccuuggcacugccgcccaucccucaauucaggcaacaaugaaguuaauggauacucucugcccuuugcucagaauuguuauagcaaaaauuuuaaaaccaaaaaauaaguuuguacuaauuucaauauggcuuuuaaaaguaugauggagaaauaaauuaggauaaaggaacuuugaaucacaaaaauaucaaaaguaaaaauuuauucucaaaacuuugcauuuguaaagaaugaugacaguagaagccuuccucuccccuccucgccuuuagggaauaaaaauucuuuagguaggaaaagaaauggaagucagaaaaacauuagaaaaagacaguaauguggguaucugaaaaggaacaaauacuuauuccucacauaggguuagugacaaugggaaaagggauaggaguagaagccacagacauaucuaggagcccugaauagaggcgcagucugccucaccuccugaaugaagcuuugcuagauaaccacguagcuuucccugugccacccuugcaugaagcagacaguauaguggauauggcaggauguuucuaggaaacaugccgauacaaaacaaugccaguaucuucagaaauccccagcccuuuccccucaccccuccuggcuaaggaaagcacuagcuuaugagagaaacccuaggaggaacaacacaguugagacaauguagcagcagcugugggugcuguguccuccacuggauuggccauuuccuagcagaaacucucccagaggaaauggucagcagugaccccauggcucuaaacagcuaugaaaucugugaggguauuucuauccaugcuaccugcaucagugaguuuaaauuuuaauuggagaaaaaagacaaaauauuaacacauuaauugauacaguauaguuuggugcaaagaacccuaaauccaaaucaaggauucaguacuuugaagcuaguauuuuaaacuuuauaaauggguaaaguaucuaacauuucuggccuuauuuuucucuuccacaauggaggaguaauaauacuuuccuugcagagcuauugauggaauuugaauaaucuugauauauagucaaugccuuacauauaguacauaaauacacaagaaaacauugugguuauauuuauaauuaauuuauuuaaaagaauggaucacguuauaugaaaaguacuuuuguuuuucucagccccuuaaugauuuaggagauucaaauguauguagaacuaugggugaauuucuuuucauaugaucauugcaggauauuguuuucuccaaaaugagagaggcugagaucaauugcuaagagaacucuuaggaugagaaaucguaauauuucacuuugguuuucaacucuuuaagaagggauauauucccuccuuguggccuauaagucuuuauucaaaguauuucauaugcaacagauguuuaugcauguuuacuuuggggaggaggugaagaaaguucaaggagaaaauaauuuaaaaugcagacuaggaaucaguaagcaagggagucugaacaagugaucaucaaaaaaauguccaucacagagcacagagcauuuuuagggcaaugaaacuacucuauuugauaccacaauguugaaaaaugucauuaugcauuugcccaaauccacagaauguacaacaccaagagugagacaauguaaaccauggacuuugggugauaaugaugugccaauguaaguucauaaauuauagcaaauguaccacucuggagggaaauguugcuaaugggggaggcuaugcaugugugggagcagaauguaucuggcagccguccccaacguuuuuggcaccagggaccaguuuuauggaagacaauuuuuucacagauaguggggggaauguggguaugauuuggggaugaaacugugaaacuguuccaccucagaucaaaaagcauuagcaagguucucauaaggaacaugcaaccuagaucuuuugcaugcacaguuaacaauaggguucgcgcuccuaugagaaucuaaugccaccacugaucugacggaaggcggggcucaguugguaaugcuaccucguccacugcaugguccaguuucuaacaggccaccagcugguacugguccauggcccaggggguuggggaccuuugggauaucucugcagcuucugcucaguuuuucugugaacuagcaacugcuuuaaaauaaagucuauuuuuuuuauuauacuuuaaguuuucggguacaugugcacaacgugcagguuuguuacacauguauacaugugccauguuggugugcugcacccauuaacucgucauuuacauuagguauaucuccuaaugcuaucccucuccccuccccccaccccacaacaggccccggugugugauguuccccuuccuguguccacguguucucauuguucaauucccaccuaugaaugagaacaugugguguuugguuuuuuguccuugggauaguuugcugugaaugaugguuuccagcuucauccaugucccuacaaaggacaugaacucaucauuuuuuauggcugcauaguauuccaugguguguaugugccacauuuucuucauccagucuaucauuguuggacauuuggguugguuccaagucuuugcauuugugaauagugccaaaauaaacauacaugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacaguccaaucaacaguguaaaaguguuccuauuucuccacauccucuccagcaccuguuguuuccugacuuuuuaaugauugccauucuaacuggugugagaugguaucucauugugcuuuugauuugcauuucucugauggccaguggugaugagcauuuuuucauguguuuuuuggcugcauaaaugucuucuuuugagaagugucuguucauauccuuugcccaguuuuugaugggguuguuugcuuuuuucuuguaaauuuguuugaguucauuguagauucuggauaucagcccuuugucagaugaguagauugcaaaaauuuucucccauucuguagguugucuguucacuuugaugguaguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucguguuuuugucagguuugucaaagaucagauaguuguagauaugcagcauuauuucugagggcucuguucuguuccauuggucuauaucucuguuuugguaccaguaccaugcuguuuugguuacuguagccuuguaguauaguuugaagucagguagcaugaugccuccagcuuuguucuuuuggcuuaggacugacuuggcaaugcaggcucuauuuugguuccauaugaacuuuaaaguaguuuuuuccaauuuugugaagaaagucauugguagcuugcugauaagcaacuucagcaaagucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggaaaacuacaaaccacuccucaaugaaauaaaagaggauacaaaccaauggaagaacauuccaugcucauggguaggaagaaucaauaucgugaaaauggccauacugcccaagguaauuuauagauucaauaaagucuguuuuuaaaaaggagacaaaaagguaaccaauuaugaucccaaauauauaaaauaaaacuuuuaguaugaaaaagucacauuaaaaugcgcaaaugugcuaagaaauuuuuagcaauaggguuucaaauaaauuucauauaaauuucaaugauucauaaggcaagaauccagcauauuggaguugugugcauuugugugcuuguguguguguguguguauguguaauauaagggguauacugaauggcaaaaugacuagucauacagaaaucuacaaaugcugcccaacucagacucauuccucaagaaguacuguggaaagcaaauuuaaugauagugcauuuuauuaaaagguuguauucaaaaaguauuuauguaauguuaaaauagcagaauuaaaacuaauucuaaaaaauaagaguaaauuuuuuuaaucagcuaaaaaaguagggucauuauugacauuacuauaaaugggguuacagaucaaccugcaugauuuuaaaucaugcgauacuuaaaaauuauuucaguuauuugaauuauuucagauuauauacauaaagugugacuucauuaauauuuaauaucacauuauuuaaaauuuacaaaauuagugggucacagaggcucgugccugugaucuuaacaguuuggaggccaauggaggaggauugcuugaagccaggaguucaacagcugccugggcaacaaaacaagaccccaucucuacaacauaaaaauaaauuagcgcaugguggcgcgccuguaaucccagcuacucuggaggcugaggcgagaggagcgaacccaggaguucagggcuucagagggcuaggauugugccacugugcucgcuccagccuaggcaacagagcaagaccccaccucuaaaaauaaauaaauaaauaaauaaauuuuacaaaauuuuaaaaaucacaugaaauauuucagguuuguacuugccacagacaaacuagggauuugaagaauuaaacauuuuauuuuacuuacagucuguacuggcacauaguaaguagucaguagguguuaacaauuaguguuauuguuauuuucuggaguccaacuaacaaaucccauagcgaaugacaccacagggaugaaaccaacaagauccagaauaugggaacuuccacuagauaacucaauuuuuucagcaacaauucaaagacagacagagagagagaaagaagagaagagaagagaagagaagggaagggaagagaagagaagcuauacauuuuuaaaaggcugaagaaauauaugaaccauauugauaugaggcaaucagaaaaauugacaccgacuguauuaaggaaauagcuaauuuuagugugguaauagcauugcuguuauguuucuaaaaagucauuauacuuuagauuuucauaauaaaauaauuaugaaug

SEQ ID NO: 1307 - RNA, 1898 nt, Homo Sapiens; identical to SEQ ID NO: 1297

SEQ ID NO: 1308 - RNA, 3674 nt, Homo Sapiens
gucuuuuauaccauuuagaguucaaaggauggucuuuacagucugacagagcuagaucugaaaucuaauucuaccacuuccuaggugugugacucagggcaaguaacuucugucagcuuucucaucuauaaaauggagauguaagacaaaaaucugccucucaggguuauaaagaacaaauaugaauuagauguaaagagcuugguaaguucucaauaaauucuaucuaucuguccuucacaggucaagcuccugauuauaaagucuuuccagucuacucugucagugaucuucccuuccucuaaauacuugacauauuuuaauucuacaacucauuugaaaauuaaucgugguuuacacugugauaucuguauucacauaucacuuuuaacauuuugaugcugaaauuuaggcucauaaggaaugaaaacuguaauuuauaucuacaaauaugaugccucuauauuguuggaaaggaucugauaucaaauauuuggucucacugaccucuuaggaacauucuuauuugucuacguaagcuuauuuugagauuguaaacguaugaucaucuuacuuuuacuucucuguacauggcuucuagcacaauacuuaacauuagagucugugaucccaaguucucaaaauuaaugauuugcugauugcugaugauccuugacacauaauaucugagcaucuuuuuuaaauaucugccauaacauuguaucuauuuuuauuaaaccauuucccagucuuccuugaaguuuacagauauguuugcuuuauaugcauguucugggcucucacauuuuguaccuacuagcacaguuuuauuauauucuaauuauucauucauguuccuugaggucagagaacacagauuucaacuuugcaggcucagccucagcucaaaaccuggcauaguugcucaauaaaucuuuacugauuagacugugagcuuuuguugggaaaaggauaugccuuuuaaugcuuuguuccuuuacugcaauucacaggggauguuggcuguuuuucaaauuaaaaacagaaaacugaggaggguagaauuucaaguuccauuuucaaaggagacacacagauaagugagaauaaaaacugucuacgacaaucagcucaacaacacgucucccuuuguaagacagaauaacaagcaauuucacaguuaagugauagggcuugucacucuucagcaguuugcugaguuuuaacccuuucacuauggcguucucuccauuauuacagagaaaggcagaugggagccucucccagcgaaaagacuacagcuuguguccuucauaggagaaaacagugauggcuccagaacuuuuauaugaaugaacuuagcacagcuaucagaguggaugguggugggagggcuagcaggaaacuaguaaacaacuacaagcugccccuucagggaaaguuucuacuuggaauauaaguuacagauuaaugaaaauagaaagauuucccaaagauacuuauucucauguuuuauaaaagaucagggaaaugucagcuguccacuuaacggaugacgauaaugaauuaagaguucgauaggcggcaggcacaacuaaaagccaaacucgaccuaagucuuaugaaauccuacuuaaugagcuuucuugacuacugcuagccucacuuaucuggcaggagucgaaggagaggaagccccaagcuccucuguuccaccaccuccaaaguccugaaccccuucucaagugucccacuucaucccugcuuccuuucgucccgugggacuaagcauuccuccugcccucacucucaccacuugcugucccucaaaaagccgacucaccccuuuccaagcgcagugaaccguccgcaaagcacgaggccgguugcgagcugcagaaagcccacgcucgccagcgggacccaaggaacgcuagaacuauacgucccagaacacuuagcuuuguuuuuaacuacggugcagccgcaaaagggaaauaccggcucaggacccaggggaguuguaguucucuaauccaaagaaaucauuauuuggcaacguacgguuuucagggggauauaccccgcgacugcguuccuguaggaugugagacaaagagaauaaauauccccggauugggugcuggugggaaaauuugcuggaagcgcagcauugguuaccaauuuugugcucaaucucucaguaccagggugaaaguggagacgcaaucucccuugaaagacguuagucuccaucucuaacgcucccgagacacgguucgcaauuaauuaugacgucacagccaaucgucaacgcgaaagccugacgcucuagccggcucuaucucgcugccccgccgcgggcgcagagcuggcgcucuagcccacggaguugguuaacuccucucaccggccccuggaaaggguuccaagugcuuuaguacccgacgcugucugggaauuccgggcguuucggcuccuuggucgcagaggcaggagggcgugcguggcaggaggguucggguuauauacuccuagguccugggacagaauaguuacgaccucugggacaggaacucuucucucuuuuguuaauaaacuuccaacucccuccucagacccgaccgcaugucugucauggaccucgccaauacuugcuccagcuuucagucggaccuggauuucuguucagauugcggcucgguccugccucugcccggggcucaggauacggucaccuguauucgcuguggcuucaacaucaacguucggggugagaggcuuguacgcagggguccuggcggagggcgcagggucggaagcuuggggaacucaagaucgguuggguugaggaggggauccuagagcaggacaucaggcgguuguacauuuggucuagcgaugaaaacugagggaaaggauguagggccuccuggccuaaccagccaggggaaaggggagguuuccggugucagcucucucugguugucuccauaaccaguucuuacuugccugugcagacuuugaggggaagguugugaagacuucgguuguguuccaccaacuggggacagccaugccuaugucgguggaggaagggccugagugccagggaccugugguaagcuaaugagaucaagaacuggcuccauaagguggguaggaaagaaauggaggagugauugcaaagcucuggagaguuuugugcccaauuccaagagggaaaagagauguaaaccaucgacguuugagaggcgugaucgccugauuccugugggaaguaaggggauaugaccaggccucccuaacccaccaguuucuucccagguugacaggcgcugcccucgauguggucaugaaggaauggcauaccacaccagacaaaugcguucagccgaugaagggcaaacugucuucuacaccuguaccaacugcaaguuccaggagaaggaagacucuugaccuuuuuccugggcaacucugcagucccucccuccuuucggaaggugaaggauacuggguuuuuagaugccuuguccauccugucugguugcaauguuuugcucccagaagagaaucagaucaucauguggggauuaccauuguuccuggaguacuccuacccuuaguugaauuuccuuauuaaaguuauauuuuucuauaagacccugaca

SEQ ID NO: 1309 - RNA, 223 nt, Homo Sapiens; identical to SEQ ID NO: 1256

SEQ ID NO: 1310 - RNA, 223 nt, Homo Sapiens; identical to SEQ ID NO: 1256

SEQ ID NO: 1311 - RNA, 5958 nt, Homo Sapiens
agagugaucucuuggcaauaguuaagcaaucaaacggagcuauaguaauggcuuauaaccaaaguacacaaucagugucaaaaagaaagacagggaugugaacacacagguucccaggagacgcggagccagaacuuagcaugggaucccagcccugcauuucucaacuuuuuuucagucugugacuuuggugggaucugucuccccacucuuugccuguccugcucugaccaucccaucugacccagguaugaacacagaguccauccacgcaguccuccccaagaggaacuuggaggaaguaggggccauguugaaucuaguaaauguggaaucacaaaauugaaauaaugugcaucugaaaagugaauaaauagaugccaagaaggagugagucauaagcacaugaguuguaagagguugaacuugagagaccagaucaggcagugccgcuuaauaccaucacaugauccuccccgaggcccuguauuuaauuaaaauagagagggaggcaccacagaugccagaagaacacuguugcucuugguggacgggcccagaggaauucagaguuaaaccuugagugccugcguccgugagaauucagcauggaaugucucuacuauuuccugggauuucugcuccuggcugcaagauugccacuugaugccgccaaacagguuggacugaaguucuucaggaagcuuucaucucuggcucacucaucucuucuucugcaaacuguugggaaggcugaaacuacagcaaaaugccuccagcuccauucuuugcuuucggcucauggaaaguaaaaacuaugcugcccuucucuugugaagcuucuuuuccauugcaauugcaacccauucuugccagacagugguugggggaggguuggacagccuccggccacagaacaaagcaacuccaccaacuaaacuauguccagcuuccauccaaaaggguggagaccucacaugaaauggggucuccaaucuggaggcaaauuuacgaaucuccccagcccugaagcuauugagaccccgcggccgcgcccuaacccucagucucccgacugcgacugcgacccgggaaaacgccuacguuuuuggaaaggaagucccaucacagggagcugacccggugucagcgcgcagcacguucccggcccgcagugcgccgcgcguccuccuagcagcccgcggagcccggcacugugauggucccgcuucccacacgaggccacgggccacagagugggcaaggaacucgccccaagccacacagcgggaaaucugcguuuugauuauguuccuggaaacaauaacuuucuuucaagaucugaggaagaggaagacucucuggaacaguggaaagaacuuguccuuguccugggaaucaaaagaugugaaucuugauuucuacuaaagaugacccuaggauuucaugaugugcugggcaaugaaagaccuucugcuuacaugagggagcacaaucaauuaaauggcuggucuucugaugaaaaugacuggaaugaaaaacucuacccaguguggaagcggggagacaugagguggaaaaacuccuggaagggaggccgugugcaggcgguccugaccagugacucaccagcccucgugggcucaaauauaacauuugcggugaaccugauauucccuagaugccaaaaggaagaugccaauggcaacauagucuaugagaagaacugcagaaaugaggcugguuuaucugcugauccguauguuuacaacuggacagcauggucagaggacagugacggggaaaauggcaccggccaaagccaucauaacgucuucccugaugggaaaccuuuuccucaccaccccggauggagaagauggaauuucaucuacgucuuccacacacuugguuggcuuuuacaaaccccuaagcuucuucuuuaccuuuccuuaaaauuucaaccuucucuuuucuuacucuauaauugagaaugauaacacagagaguuaauaacagucacccugcuaacuuuccuuagcaugagugaacagugagagauaaaaaugaaaucuugguuaaccuugccaaaucuccaggacaccgaagaguuaaaaagagagaaaaacaaaaagauuaagcucuuuuucaaaaaaacaaaaccacuuaauuuuuuucuaccuaaaaccauaacaagaaaaaaugcuaacacuuauuuauuugaauggcacauggagaccgggcauguggcucacacuuguaaucccagcaccuuggaaggcggaggcggguggaucaccugaagucaggaguucaagaccagccuggccaacauggugaagucccgucccuacuaaaaauacaaaaauuagccaggugugguggugcgcaccuguaaucccagcuacucaggaggcugaggcaggagaaucacuugaauccgggagguggagguugcagugagaggagauugagccauugcacuccagccugggcaacagagugagacuccaucucgaaaaacaaacaaacaaacaaaaaacagaauggcacauugaugagcauucauugauugauucuuuaguuuuuuuauguucucuaaagaauuuuuaagauuuaaagaagcaugugcuauuuauuuguaggaaauccucagaaaagguacaaauaaaaaauaaaaauuauccauaauuaauaccagagauuauaauuguuaauuauuaugguguuuucuuugcuaguauuuaagaucauuauuaagaucacauacacauuuuugcuuacuaucauuagcauuugaugauaugauuuuuuuaauuuuuauacauuguuuuaauggcugcacgauauuucauuguguacaaauaaaauaacuacuguuccgcuuugaccuagucaguauuuccagaaauugggacgauguucagugagaguuucugugaacacagccaaugugacacuugggccucaacucauggaagugacugucuacagaagacauggacgggcauauguucccaucgcacaagugaaagauguguacgugguaacagaucagauuccuguguuugugacuauguuccagaagaacgaucgaaauucauccgacgaaaccuuccucaaagaucuccccauuauguuugauguccugauucaugauccuagccacuuccucaauuauucuaccauuaacuacaaguggagcuucggggauaauacuggccuguuuguuuccaccaaucauacugugaaucacacguaugugcucaauggaaccuucagccuuaaccucacugugaaagcugcagcaccaggaccuuguccgccaccgccaccaccacccagaccuucaaaacccaccccuucuuuaggggguuucaccauguuagucaggaugggcucgaucuccugaccucaugaucugccccccucggccucccaaagugcugggauuacaggcaugagccacugcacccggccaguuucaacgucuuauuugcuucuuguguucacacaaaaugugggauuaugcuuccuuacauaauuuagcaauuauaauaccuuauagcucucacaucuguguaaauuaugacacauuuaguucaaauuucuauagcaauuucauaguauaguguuccugauauuuuucuaaaaagcaaauggcaaauguuuagauuuuuuauuauaucacauguaucuuuuauguucguagcaacuacucuaaaaucuuaugauucaaacaccccaggaccugcuggugacaacccccuggagcugaguaggauuccugaugaaaacugccagauuaacagauauggccacuuucaagccaccaucacaauuguagagggaaucuuagagguuaacaucauccagaugacagacguccugaugccggugccauggccugaaagcucccuaauagacuuugucgugaccugccaagggagcauucccacggaggucuguaccaucauuucugaccccaccugcgagaucacccagaacacagucugcagcccuguggauguggaugagaugugucugcugacugugagacgaaccuucaaugggucugggacguacugugugaaccucacccugggggaugacacaagccuggcucucacgagcacccugauuucuguuccugacagagaugagccggggaagggcacuccuguaagggggcacggaggucugaaagagcacggggaguauggccaacuuucaggauuuuuagcacagcuagaagaggugucuccaggacgugacaucucucccccgcgcccuuaccacaguguuccagacaugcugacucauucucuaaauagaagauaagcugacccaaagacuauguauuauuuaauagaaaagauuacugaaagcccagagggagccauauaucuucugugacggcucccuuccucauuuauuuaauggcauuauaagcggcauguccucuagguggaagacauaacuaacaugcucuugcuucuguuuuaagacccagccucgccuuuaaggauggcaaacagugcccugaucuccguuggcugcuuggccauauuugucacugugaucucccucuugguguacaaguaaguuuuugguuccuacgcuuuauaucacuauaguguauugucaaaagugaauauaucucuguguaaauaggcauuuuucccuuuuuugcuuuuaaacauuuuguguaggggaggaaaauauuacauugaauggugaauaccaaacuggccuguuaaucuuguugugguuuguuuuuaauccuaaaagaugcuaccagaucucaguaacuuuacaaaauuaugucaacuuaauuuuaacaugauagucucaaauuauaguaagcaggcacauuucuugcaugaacaagaguaaauaaauguacuuucauaaaacacaaggaauacaacccaauagaaaauaguccugggaauguggucagaagcaaaggccugagugucuuucucaaccgugcaaaagccguguucuucccgggaaaccaggaaaaggauccgcuacucaaaaaccaagaauuuaaaggaguuucuuaaauuucgaccuuguuucugaagcucacuuuucagugccauugaugugagaugugcuggaguggcuauuaaccuuuuuuuccuaaagauuauuguuaaauagauauugugguuuggggaaguugaauuuuuuauagguuaaaugucauuuuagagauggggagagggauuauacugcaggcagcuucagccauguugugaaacugauaaaagcaacuuagcaaggcuucuuuucauuauuuuuuauguuucacuuauaaagucuuagguaacuaguaggauagaaacacugugucccgagaguaaggagagaagcuacuauugauuagagccuaacccagguuaacugcaagaagaggcgggauacuuucagcuuuccauguaacuguaugcauaaagccaauguaguccaguuucuaagaucauguuccaagcuaacugaaucccacuucaauacacacucaugaacuccugauggaacaauaacaggcccaagccugugguaugaugugcacacuugcuagacucagaaaaaauacuacucucauaaaugggugggaguauuuuggugacaaccuacuuugcuuggcugagugaaggaaugauauucauauauucauuuauuccauggacauuuaguuagugcuuuuuauauaccaggcaugaugcugagugacacucuuguguauauuuccaaauuuuuguacagucgcugcacauauuugaaaucauauauuaagacuuuccaaagaugaggucccugguuuuucauggcaacuugaucaguaaggauuucaccucuguuuguaacuaaaaccaucuacuauauguuagacaugacauucuuuuucucuccuuccugaaaaauaaagugugggaagagacaaga

SEQ ID NO: 1312 - RNA, 6022 nt, Homo Sapiens
agcgcgcaugcucgcggcucggcgcugaaauucaaauuugaacggcugcagaggccgaguccgucacuggaagccgagaggagaggacagcugguugugggagaguucccccgccucagacuccugguuuuuuccaggagacacacugagcugagacucacuuuucucuuccugaauuugaaccaccguuuccaucgucucguaguccgacgccuggggcgauggauccguuuacggaggugcgggccggggucgccgcggcugcggccugcugugguugguuucgguccuacagauaaaacucagggaggaaggcuuugagucuguccuaaaaggcuguugcgagaggucuuucagcccccguuuuuaccaugucccucugcaguccuggcgcagcaagagugaggcgcaggccugcggaacggguccugcuggaagcagcuggaaugcccugcagggcgggguccggggccggugacucagugcggcugccgccgggaaaggcaguaggaugugugauuugcggaguucacgcagcccgcaggggagaugcuaaugaaaugacagcaaaacguuaaaauaagcagaaacugcuggagcgaacccgugccaggcgagagaaucuucagagaaaaauggcugagaggcccacagcagcuccaaggucuaugacucaugcuaagcgagcuagacagccacuuucagaagcaaguaaccagcagccccucucugguggugaagguagaaaucuuguacaaaaccaucgccaucaaaaaaacgcuguucugacaacacugaaguagaaguuucuaacuuggaaaauaaacaaccaguugagucgacaucugcaaaaucuuguucuccaaguccugugucuccucaggugcagccacaagcagcagauaccaucagugauucuguugcugucccggcaucacugcugggcaugaggagagggcugaacucaagauuggaagcaacugcagccuccucaguuaaaacacguaugcaaaaacuugcagagcaacggcgccguugggauaaugaugauaugacagaaagccugcaaaguguguacuggcaucuagugacaauggcaaaaccaacuucagggcagugguauaggcagaagaugacauuccugaaagcucacucuucucaccaaugccaucagaggaaaaggcugcuuccccucccagaccucugcuuucaaaugccucggcaacuccaguuggcagaaggggccgucuggccaaucuugcugcaacuauuugcuccugggaagaugauguaaaucacucauuugcaaaacaaaacaguguacaagaacagccugguaccgcuuguuuauccaaauuuuccucugcaaguggagcaucugcuaggaucaauagcagcaguguuaagcaggaagcuacauucuguucccaaagggauggcgaugccucuuugaauaaagcccuauccucaagugcugaugaugcgucuuugguuaaugccucaauuuccagcucugugguaauguuuucauguuucagaaagcuacuucuccagugaaaucuacuacaucuaucacugaugcuaaaaguugugagggacaaaauccugagcuacuuccaaaaacuccuauuaguccucugaaaacggggguaucgaaaccaauugugaagucaacuuuaucccagacaguuccauccaagggagaauuaaguagagaaauuugucugcaaucucaaucuaaagacaaaucuacgacaccaggaggaacaggaauuaagccuuuccuggaacgcuuuggagagcguugucaagaacauagcaaagaaaguccagcucguagcacaccccacagaacccccauuauuacuccaaauacaaaggccauccaagaaagauuauucaagcaagacacaucuucaucuacuacccauuuagcacaacagcucaagcaggaacgucaaaaagaacuagcaugucuucguggccgauuugacaagggcaauauauggagugcagaaaaaggcggaaacucaaaaagcaaacaacuagaaaccaaacaggaaacucacugucagagcacuccccucaaaaaacaccaagguguuucaaaaacucagucacuuccaguaacagaaaaggugaccgaaaaccagauaccagccaaaaauucuaguacagaaccuaaaggguuucacugaaugcgaaaugacgaaaucuagcccuuugaaaauaacauuguuuuuagaagaggacaaauccuuaaaaguaacaucagacccaaagguugagcagaaaauugaagugauacgugaaauugagaugaguguggaugaugaugauaucaauaguucgaaaguaauuaaugaccucuucagugauguccuagaggaaggugaacuagauauggagaagagccaagaggagauggaucaagcauuagcagaaagcagcgaagaacaggaagaugcacugaauaucuccucaaugucuuuacuugcaccauuggcacaaacaguuggugugguaaguccagagaguuuaguguccacaccuagacuggaauugaaagacaccagcagaagugaugaaaguccaaaaccaggaaaauuccaaagaacucgugucccucgagcugaaucuggugauagccuugguucugaagaucgugaucuucuuuacagcauugaugcauauagaucucaaagauucaaagaaacagaacguccaucaauaaagcaggugauuguucggaaggaagauguuacuucaaaacuggaugaaaaaaauaaugccuuuccuugucaaguuaauaucaaacagaaaaugcaggaacucaauaacgaaauaaauaugcaacagacagugaucuaucaagcuagccaggcucuuaacugcuguguugaugaagaacauggaaaagggucccuagaagaagcugaagcagaaagacuucuucuaauugcaacugggaagagaacacuuuugauugaugaauugaauaaauugaagaacgaaggaccucagaggaagaauaaggcuaguccccaaagugaauuuaugccauccaaaggaucaguuacuuugucagaaauccgcuugccucuaaaagcagauuuugucugcaguacgguucagaaaccagaugcagcaaauuacuauuacuuaauuauacuaaaagcaggagcugaaaauaugguagccacaccauuagcaaguacuucaaacucucuuaacggugaugcucugacauucacuacuacauuuacucugcaagauguauccaaugacuuugaaauaaauauugaaguuuacagcuuggugcaaaagaaagaucccucaggccuugauaagaagaaaaaaacauccaaguccaaggcuauuacuccaaagcgacuccucacaucuauaaccacaaaaagcaacauucauucuucaguucuucacagucauggccaguccaggaggucuuagugcugugcgaaccagcaacuucgcccuuguuggaucuuacacauuaucauugucuucaguaggaaauacuaaguuuguucuggacaagauaaauuaugauguaagagagcgagagcuacugggcuauuuguuccaggaaaagguccccuuuuuaucuucuuuggaaggucauauuuauuuaaaaauaaaaugucaagugaauuccaguguugaagaaagagguuuucuaaccauauuugaagauguuagugguuuuggugccuggcaucgaagaugguguguucuuucuggaaacuguauaucuuauuggacuuauccagaugaugagaaacgcaagcuuucaccagugaugcauaagaaacuguauuacucacucccuaaccaaucaacagagguuguuacuguuuuuuccagacuuagccaaucuaagguuuuaaauugguauguucuauuuuuauuuuuaaaaauucuaauagaguugacacacuuauuggcuguuggcucaugugugccuauauguguuucuuuucccauuuucaggaccauuuggucucgugaauguuuuccuccacuuugacucguaucauaggaauucauggcugccaacaauccagggcaguugucugcccuuaucuuucauagauauauaaagaaauauuuacacaugaaauccaaugucuagguuuccuuuuauagaaaggggagaaguggguaaguuguagauaaaaggcacuugaguguguuucucauuguuauagcugguuuugguaccuggggcucauuauacuguuguuuguauuuuuuauuugaaguucaccauaauaaagagcuuuauaggauaguuggcaagagcuaccaguugauauuuuuggguuuuauuuuuaugucuagcuaggaacaauaauaaauguuaaauauguuucucuaagcccaguguaacuaaauuuuaacuuuuaaauaauagcuuuuuaauauuuaauuuguaccaacuuaaaugcugcuuaaugcuuacugacuuaaauagucuuauuuucuacuaauuucucuuaauuuguuuuuaaagaaucccauaggaaggauaaaucuggcuaauuguaccagucgucagauagaaccagccaacagagaauuuugugcaagacgcaacacuuuugaauuaauuacuguccgaccacaaagagaagaugaccgagagacucuugucagccaaugcagggacacacucuguguuaccaagaacuggcugucugcagauacuaaagaagagcgggaucucuggaugcaaaaacucaaucaaguucuuguugauauucgccucuggcaaccugaugcuugcuacaaaccuauuggaaagccuuaaaccgggaaauuuccaugcuaucuagagguuuuugaugucaucuuaagaaacacacuuaagagcaucagauuuacugauugcauuuuaugcuuuaaguacgaaaggguuugugccaauauucacuacguauuaugcaguauuuauaucuuuuguauguaaaacuuuaacugauuucugucauucaucaaugaguagaaguaaauacauuauaguugauuuugcuaaaucuuaauuuaaaagccucauuuuccuagaaaucuaauuauucaguuauucaugacaauauuuuuuuaaaaguaagaaauucugaguugucuucuuggagcuguaggucuugaagcagcaacgucuuucagggguuggagacagaaacccauucuccaaucucaguaguuuuuucgaaaggcugugaucauuuauugaucgugauaugacuuguuacuaggguacugaaaaaaaugucuaaggccuuuacagaaacauuuuuaguaaugaggaugagaacuuuuucaaauagcaaauauauauuggcuuaaagcaugaggcugucuucagaaaagugauguggacauaggaggcaaugugugagacuuggggguucaauauuuuauauagaagaguuaauaagcacaugguuuacauuuacucagcuacuauauaugcaguguggugcacauuuucacagaauucuggcuucauuaagaucauuauuuuugcugcguagcuuacagacuuagcauauuaguuuuuucuacuccuacaaguguaaauugaaaaaucuuuauauuaaaaaaguaaacuguuaugaagcugcuauguacuaauaauacuuugcuugccaaaguguuuggguuuuguuguuguuuguuuguuuguuuguuuuugguucaugaacaacagugucuagaaacccauuuugaaaguggaaaauuauuaagucaccuaucaccuuuaaacgccuuuuuuuaaaauuauaaaauauuguaaagcagggucucaacuuuuaaauacacuuugaacuucuucucugaauuauuaaaguucuuuaugaccucauuuauaaacacuaaauucugucaccuccugucauuuuauuuuuuauucauucaaauguauuuuuucuugugcauauuauaaaaauauauuuuaugagcucuuacucaaauaaauaccuguaaaugucuaaaggaa

SEQ ID NO: 1313 - RNA, 2569 nt, Homo Sapiens
guuggcgcuuccgguggccugcgaccccguaauugccucggugaugucguggguucaagcagccuccuugauccagggcccuggagacaaaggggacguguuugacgaagaagcagacgagucgcuccuggcgcagcgggaauggcagaguaacaugcaaagacgagucaaaauuucucgaugguuacuugaaagcguguaaaacaacaagacgcauucuuugagcgccuacgggaugcguuagaaacugaggaccgaccaaaauuaacuauguguagacuuugaacaguuugcaguuuguugaggaucacagggaaaggagcuggagagaaacauacacuauacuuauuauggcugucaaaggacguguacgcaguuuauauggguggcuugaauggguagggagccuaaaguuaaggaguaguguuaaucaagacauauugaaaagaugaacuaaagcaugcugucagaggacaauaagggaaagcuaauguggaauacuggugucuagaaaacugugacuaucaguguuuuaaaaauugcccgguaacucuagacuucaaaagugggauaaguaaugauaaaccaauaauaaacuuaggagaagcauagucugcuuuaguuauauuguuaugccauauuauggucaguaacacaguaaaggccuaauucaucugcuuucuaaauugguucuguacuuuucuagaaaagccuacauguauauacuuaguuacagcugcacuucuccauuacuuauuuuuaggaagguuauagagauggaauagaugcuggcaaagcaguuacucuucaacagggcuucaaucaagguuauaagaaaggugcagaagucauuuuaaacuauggacgacuccgaggaacauugagguaauuuuuaaagucuaaaugcugaaucauuuuaaccucaauacuacuggaggauguuucuguauaaauaaaguguuuaaacugaaaugcuuuuccuggugcuaaauacacuaaagcgugucgcagaucauagaauuauauugccuucaaaaagucaaaaucuuuaucagcucaucuacuuuaaugugugaacuacauauugucuuuucgugcaaagaaaugguaagaagauguauacuucugcuaccugaacaauuaucuaucucauugaaaggucuucagauuuugaauaaaacuuguaguacuuccacacaguaugacagaccucuagacuagaaguacaugaugaaaauaguugguaauuaagauaaaauuugcuuugcucuccuggugucaccuucauaauaauaauucaacuuugaucaauaaaauaaacaaucuucuggaugcaguuggccagugugaagaguaugugcucaaacaucugaaaucaaucacuccaccgucccauguuguagauuuauuggacuccauugaggauauggaccuuugucauguaguuccagcugagaaaaagauugaugaagcuaaagaugaaagacucugugaaaauaaugcugaguuuaacaaaaacuguagcaagagccauagugggauagauuguucauauguagaauguuguagaacacaggagcaugcacauucagaaaacccaagccccacauggauuuuggaacagacagccaguuuaguuaaacagcugggccuaucaguagauguauuacaacaccucaaacaacuauaaaauuaccuucccuuuucuaaugaaaauaauguucagaacauuugguuuccuaacaaucgaaauuuguacugguuucugcaucaaacaccucaacuguaggguuacccuuuauggaaguuugaaauuaacacuauugucuucaaaauuaacacuauuaaauguaauauaagccuuugaacucaacggauuggagccuacugggcuugagagccccgcugaggaguccggagguugggacgcaacuacugccgcguccccucccgguccccggccacauggcgagcggggcgacaccgaagcagcccacggagcucgaggcgacgcugcugagccugguuccccaaagcggccgcgccacuccccgcuuccccgcccggcuccgggccccaggcccugggacgccgagccaccgccggcguuucagacgcaaaccccaccgcgacccugcagcagccugccccgccuggccgccagaggcaccuuccaacuccgaaacacauuuuucaacauauaauagaaucauuaucagagguggacacauuuagaaguuguucuuaaucagagggcagcuugugcuuaggaaagccagccucaguccucagcacccagcacccagugcugcagguuucuccugggugaagauggaccagcccaccuuggcccuccggcaagcuagaacaauauguacacgucucucaaacuaugaagagaagauuugggaggaguaugagaaaauccucaauaccaaacuagcagagcaauacgagucguuugugaaauucacacaugagcagauuaugcgaccaugugggacaagcccaacaaacuaugugucuugaagcuuuuuguugcagaucucgguaccagguuugaccucaa

SEQ ID NO: 1314 - RNA, 2602 nt, Homo Sapiens
aacagagacaaaucuucguuauaaguuuaucagaaaaugaugauguuaucgaauugggagaauggggaaaguuguggggacagugauaacagagccaaaucucugucuauccaauugucuaucaaaacaggaacucaacggauuggagccuacugggcuugagagccccgcugaggaguccggagguugggacgcaacuacugccgcguccccucccgguccccggccacauggcgagcggggcgacaccgaagcagcccacggagcucgaggcgacgcugcugagccugguuccccaaagcggccgcgccacuccccgcuuccccgcccggcuccgggccccaggcccugggacgccgagccaccgccggcguuucagacgcaaaccccaccgcgacccugcagcagccugccccgccuggccgccagaggcaccuuccaacuccgaaacacauuuuucaacauauaauagaaucauuaucagagguggacacauuuagaaguuguucuuaaucagagggcagcuugugcuuaggaaagccagccucaguccucagcacccagcacccagugcugcagguuucuccugggugaagauggaccagcccaccuuggcccuccggcaagcuagaacaauauguacacgucucucaaacuaugaagagaagauuugggaggaguaugagaaaauccucaauaccaaacuagcagagcaauacgagucguuugugaaauucacacaugagcagauuaugcgaccaugugggacaagcccaacaaacuaugugucuugaagcuuuuuguugcagaucucgguaccagguuugaccucaaggcaugguugcuauacauuuuuugcaacuguuugauaucacauuucagcuccaacuuugcauccugagaacauuccaacguuucugcagguccauuuuauacgacuugaaagaccuuaaaacuuucugguugccacagguauaucuuucuuuucuguucauccaguaaauagucauacccuacugugacagauuuuuccaaacaaaaauaccuggagcagcaguguagcaaaauaugccuucaguggcacucaacaaauggaguuuccccaagcacaguucuguaagaagugugugugagaguguguaugugucuguacauguacuuuagauuaugguuuguauugugcaaauuuuuuugaucuuggggauucuggcuguggauuugaugcagaaaauuaugguuaaaaacuauggucuacagaagauacuuaaugcuuugugacuauauaaauuguaacaguggauuguuuuauguguagguauuauuguuaaauauggggacuguucaccaggcacaaaauaggaaucauaaauuaggaugcaggcuggguaugguggcucaugccuguaaucccagcacuuugggaggaggccgagcugggcggaucgcuugaggagaguucgugaucagccuggccaacguggagaaacccugucccuacuaaaaauacaaaaauuagguggacaugguggcgagcaccuguaaucccagcuucucgggaggcugaggcaggagaaucacuugaaccagggaggcagagguugcagugagcccagauugugccacugcacucuagccucggugacagaguaagauuccaucucaaagaaaaaaaaaaaaagugaagauggccauuggcugugguuaugacaauacagugaaagucuguugucuuagauauacaaauacauagugagaaauuagaacaaacuggagacuggccuuugacacauggacucugccuagcuguguuagaaaaauauuuaacuccaagccuuaaaauucccaaauggaguuggugcuuaccucauucacacaauccaagaguucacuggguccugaaccucuaaagggaaaaggucuccccuggagcaggagcaucagaguuugcucgggggcauaagguaggugagugcugggccgaggcaggcuccccuggcacugcuaguugcaggagcacuuuaccuuuguaucaguuacuaaaaacaaaauuugaauccuuuggucagguucccccaaauuauuuugagguagccauguuuaagugcuugagcuuuuguguuggcaaaccccugcccaagguugcuaauaggguauucugccccuuguuuccacagcugaggcacagaaaguagccucuuuugugaggaguugggaguuaaguauacauuuauuuuuuuaccaugauuuguucaggaccacauuuuacaagauaccuuguuuccuuuauuauuguuucuggaaaguccuauucauauuauuuuauuugaauauagaauauaguuuuuuuaaaugagggcuuauuuugaaaaauucugagcuuaauucaaauuuaugccaauaccuucccaaauaagguaauagucaaagacagauguucugaucaaauggcuuagagauaguccuggaauauucauauucaaagauuccuuauuaaugaaugucuuuaacuuaaaucuacccaauaauugcaacaugguucuuuguacauuuucauuauaugguguuaacaagcuucacugcaaacaaauaaauuacuuaaguu

SEQ ID NO: 1315 - RNA, 133 nt, Homo Sapiens
gcauggccgaauacuguguuuuuaucaguaguuuacacagccagacaccaugcaaaagcagucuucccuuuagaaugacugaugguaugcuaagguuuuucauagcauaucauuauuaaaggugaauacaaau

SEQ ID NO: 1316 - RNA, 774 nt, Homo Sapiens
cugggaguaguuucuuaaccgcuuucggcuguuggucgcagggcuaccggccuacagucccagcaagcgccgggcugcgggguggugagcagucccggagggaggcgcaagccguguggaccucucugcuuccaaaccuaugcuggccacugauucugugccaucccuggcuaaggggagugaguccagagagggacuuaaggggcaagucggggcugggcagugagaagagugugacgcugcgaagugcaccucaucuuugccuaaaucgggcgggucucagccucaccccaccucucgcugcucagcucgguuucccuccagagcaucacgccuccuccagcacaggagccgccugcuuuccuaggcugcuguggaacuggccugaggucccagacgcuguccauugugcugccgcccuccgcgcucuccagccagagcgccaguucaccggcuuuugggagaacuccgccgccucaccugcccgcggacaaggucacagcuuugcaggggguugacaugggcuguggcuuccuggaaaugucacccucaccagagccuuuuacauggaugugaauuuugagacaugaaggaggggcugcaccccauggaccuggguuccuggagucuuugacggcuuuguguggucgacuuguuuugauacugaggacaccccugcuggcuguuaauuucagggcaagggauaugaggccauuauuuuaagugaaauaacucaagaauggaaaauaaaauacuauuauuuuucacuuauaa

SEQ ID NO: 1317 - RNA, 1239 nt, Homo Sapiens
auggcuaaaagaccgggacccccuggaagccgagaaaugggacuguugacauucagagacauagcuauagaauucucucuggcggaguggcaaugccuggaucaugcucagcagaauuuauauagagaugugauguuagagaacuacagaaaccuguucucccuggguaugacugucucuaagccagacuugaucgccugucuggagcaaaauaaagagccccagaauauaaagagaaaugagauggcagccaaacacccaguuacauguucucauuucaaccaagaccuucagccagagcagagcauaaaagauucacuccaaaaaguaauaccaagaacauauggaaaauguggacaugagaauuuacaauuaaaaaaauguuguaaaagaguagaugagugugaggugcacaaaggagguuauaaugaccuuaaccaauguuugucaaauacccaaaacaaaauauuucagacucauaaaugugucaaagucuucaguaaauuuucaaauuccaauagacacaaugcaagauauacuggaaagaaacauuugaaauguaaaaaauauggcaaaucauuuugcauguuuucacaccuaaaucaacaucagauaauucauacuaaggagaaguccuacaaaugugaagaauguggcaaauccuuuaaccacuccucaagcgguacuacacauaaaagaauucuuacuggagagaaacccuacagaugugaggaauguggcaaagccuuuagguggcccucaaaccuuacuagacauaagagaauucacacuggagagaaacccuacgcaugugaagaauguggccaagccuuuaggcgcuccucaacacuuacuaaccacaagagaauucauacuggagagagacccuacaaaugugaagaauguggcaaagccuuuagcguauccucagcccucauuuaccacaagagaauucauacuggagagaaacccuacacaugugaagaauguggcaaagccuuuaacugcuccucgacucuuaagacacauaagauaauucauacuggagagaaacccuacacaugugaagaauguggcagaaccuuuaacugcuccucaacuguaaaggcacauaagagaauucauacuggagagaaaccauacaaaugugaagaaugugacaaagcuuuuaaguggcauucaagucuugcuaaacauaagauaauucacacuggagagaaacccuacaaauguaaauaa

SEQ ID NO: 1318 - RNA, 135 nt, Homo Sapiens
uugcauucuuaaacccucuugguggcuucccuguaaaugcuuccaagauaugagcgaaugcuauagaaauugcaggaaaguccaaagggcugcgcgucuccuguggcucagucuuauuucauaccugcaacaucu

SEQ ID NO: 1319 - RNA, 2018 nt, Homo Sapiens
acagucgccaugacgaccgguagguccgcaacggcugcggggacaagaccguugaggcugccaggcgagucaggccuuucuggaccucgccugacucggcugggcugugccugaaauugacccagcucuaucagggauuaugaaaaaacaaggaguaagcccgaagccgcugcagucuucccgccccagccagucuaagcggcggugcgggccucccccuucccccccgccuccgccccggagccggagguagaggagguggaaaagucggcccuaggcggcgggagguccuuccggcggaggauccgaaauguggaaaaucgaaaaggcuuggagcuaaaggugguggccaagacccuucuucucggccccuuccuguugguccguaauucccuggcgcagcuccgggaagaggugcacgaacugcaggcguggugguuccccagcagaaccacuuuggacuucgcaguccuuguggcuuaucuccauugguuacauuuaguaaaacuuugugaaaauuaucgucauuucucucaccucucaucuuuggaacgggagaugacuuuuugcaccaaaaugguuagguuucuucuucuaacgaauuaauuugugguuuaagaauagcgagacuaugagguagagauguauuaggaauugaaaugaacuuuuggugaacugcacuguuucauaagcuauaacccagguuuauuauuuaaauaguaaaguguuugagauuauuuuucuguuacuucauuaucucucacccuuuccuaaugcagacuucuuuuuaagauaauaaagaugaauuauaauagcugaggaaggagaagaaugcaagcucugaaaugacauccuuaaaugcugauacugguuacaaccucuuuaccucucugaggaaauuguaacagugugucuuuuaggguguuuuuauuuuaccagcccuuaagaaagaucucuaauacguuuuaaugcuuuuuuuuauaauuucaaguugaaguguuuuuaaaaacaccuuguuuuguaauguuuugaaucucuugagauguauuuaccccacuagauacauauuugccacugguuaguucuccaucuaagcucaagagguuauucaucucucuuuagauuccagugguuuuucuuuuaacuuccagguaaaauagaaacugcuaugguauacaaccaaauuuugggguuaaacauaaucagaaaagaaaauccaguuaaauuuaugaagugagauuuucagauccuagaucuugaauauagcaaaggucuuuucaucuugauggccccaaagcuuguuggucauagucuauuucuggccauuaucuucuuaaauaaucuauuuuuaagcccucauuuauuuuugguuuuggaugaggaaagucauguuuucuaaguccucuccccuaauaaaaccuacccaacaauagugcuuugaaaagugguaguuaucuugaagauacucuugccaaaugcaaagauaaacauucuuuuugucugcuuuauaaauaugaaauaugccagaucuauaguauuuuaaugugcaucuacuuuaaaugagucaucuugggguuuuuauaauucccuuacauucuugccccucuacacuugaaauaacaaaauaccuuaauuuuauagauuaguucucuuauaguagacaggcagcuauaugcagcaaaaccaauaaaguuauuuuucaacuuucauaguuguaaaauauuuuauagcaauacaaaacagcuaagaaaacaugccacauuuuauuuuagcauuuucaaauaauuuguuuuugguguaagcacaggauaaaaaaggagagcgucaaagaaaagagacauaacaccuaacauucauaaaaauuaacaaaguauauuuuggaugauauuuuuacaggaaauauuuuaaauaaguugguagaauuuuuaaaaugguacuguauuagcuaauaaaauauucaguacaaauauauguuuggauuuaugcauuaaaaaacuaauaaaauuauuuccaacuuu

SEQ ID NO: 1320 - RNA, 8733 nt, Homo Sapiens
gccauguugauuucugauccuugagcuuuucuguguuucucuguucauucuucauggcauccuuggaaggaugccaagcuaaggaggccaggggggaauaaaaggaguccaggcucccaacugugcccuuccccucuccccugggagcaaccacuuaggguccucaugguuccuccagucuggacucugcugcuucuggugggggcugcccuuuucaggaaagagaagccuccggaccagaagcugguuguucgcagcucuagggacaacuauguccucacccagugugauuuugaggaugacgccaaaccccucugugacuggucccaaguguccgcagacgaugaagacuggguucgagccagugggcccucucccaccggcuccaccggggcccccgggggguacccuaacggagagggcagcuaucugcauauggaaucgaacagcuuccaccgugggggaguggcccgccugcucagccccgaccuaugggagcaaggcccccucugugugcacuuugcccaccacauguucgggcugucuuggggcgcccagcucaggcugcugcugcucucgggugaagagggccgccgccccgaugugcucuggaaacacuggaacacccagagacccuccuggaugcucaccaccgucacugugcccgcaggguucacccugcccacccggcugauguuugagggaacacgggguagcacugccuaccuggacaucgcccuggaugcccucucuauccgccggggcuccuguaaucgcgucuguaugaugcaaacaugcagcuuugacauuccaaaugaccucugugacuggaccuggaucccaacugccuccggggccaaguggacucagaagaaagggucaucaggaaagccaggcguggggccugauggcgacuucucuagcccugguaguggcugcuacaugcuccuggaccccaagaaugcaagaccugggcagaaagcuguccuccugagccccgugagccuguccucuggcugucugagcuuuuccuuccacuacauccuccggggccagucuccuggugcagcccuccacauuuaugcuucagucuuggggaguauccggaaacacacucucuucucaggacaaccugggcccaacuggcaggcuguuucugucaauuacacagccgugggacggauacaguuugccgugguaggcguuuuuggaaagaccccagagccagcuguggcaguugaugcaaccagcauugcuccuuguggggaggguuuuccucagugugacuuugaagacaacgcccaucccuucugugacuggguccagacuuccggggaugguggacacugggcccucggacauaaaaauggacccguccauggcaugggcccugcgggagguuucccuaaugcagggggucacuauaucuaccuugaggcugacgaguucucccaggcaggccagucagucagacuggugagccggcccuucugcgccccaggugacaucugcguggaguucgcauaccacauguauggccuuggggaggguacuaugcucgaacuccuccugggaaguccugcggggagucccccgauuccucucuggaaacgcguggggucucagcgcccuuacuggcagaacaccuccgucaccguccccucaggacaccaacagcccaugcagcuuauuuucaagggcauccagggaagcaacacggccucugugguugcuauggguuucaucuugaucaauccugggacuuguccaguaaaagugcuaccagagcuuccucccguaucuccaguuucuuccacuggcccuucugaaaccacuggccucacagaaaacccuacaaucuccaccaagaaaccuacaguuuccauagaaaaacccagugucaccacagaaaagcccacaguccccaaagaaaagcccaccauucccacagaaaaacccaccaucuccacagaaaaacccaccauuccuucagaaaaacccaacaugcccucagaaaaacccaccauucccucagaaaaacccaccauccucacagaaaaacccaccauucccucagaaaaacccaccauucccucagaaaaacccaccauuuccacagaaaaacccaccguccccacagaagagcccaccacccccacugaggagaccaccaccuccauggaagagccugucaucccuacagaaaaacccagcaucccuacagaaaaacccagcauccccacggaaaaacccaccaucuccauggaagagacuaucaucuccacagaaaaacccaccaucuccccagaaaaacccaccauccccacagaaaaacccaccauccccacagaaaaauccaccaucuccccagaaaaacccaccacccccacagaaaaacccaccauccccacagaaaaacccaccaucuccccagaaaaacccaccacccccacagaaaaacccaccaucuccccagaaaaacucaccauccccacagaaaaacccaccauccccacagaaaaacccaccauucccacagaaaaacccaccaucuccacagaagagcccaccacccccacugaggagaccaccaucuccacagaaaaacccagcauccccauggaaaaacccacucuccccacugaagaaaccaccaccucuguugaagagacuaccaucucuacagaaaaacucaccauccccauggaaaaacccaccaucuccacagaaaaacccaccauccccacagaaaaacccaccaucuccccagaaaaacucaccauccccacggaaaaacucaccauccccacggaaaaacccaccauccccauugaagagacuaccaucuccacagaaaaacucaccauccccacagaaaaacccaccaucuccccagaaaaacccaccaucuccacggaaaaacccaccauccccacggaaaaacccaccauccccacugaagagacuaccaucuccacagaaaaacucaccauccccacagaaaaacccaccaucuccccagaaaaacucaccauccccacagaaaaacccaccaucuccacggaaaaacccaccauccccacggaaaaacuuaccauccccacggaaaaacccaccauccccacagaaaaacccaccauucccacagagaagcucacagcccugaggccaccccaucccagccccacagccacugggcuggcagccuuggugaugucuccacaugcuccaaguaccccuaugaccagugugauucugggcacuaccacaaccuccagauccaguacagagcgcugcccuccaaaugcccgcuacgaauccugugcuuguccugcuucgugcaagagccccaggccuagcugugggccccucugucgggagggcugugucugcaacccuggcuuuuuguuuagugacaaccacugcauccaggccucuuccugcaauugcuucuacaacaacgacuacuaugagccuggggcagagugguucagccccaacugcacagaacauugccgcugcuggcccggcagucgggucgagugccagaucucucagugugggacacacaccgugugccagcuuaagaauggccaguauggaugccaccccuacgcaggcacugccaccugcuuggucuacggagacccucauuaugucaccuuugacgggaggcacuuuggcuucaugggcaagugcacuuacaucuuggcccagcccuguggcaacucaacagacccauucuucagggugacagccaagaaugaggagcagggacaggaaggcguguccugccugagcaaagucuacgugacccugcccgagagcaccgucacccugcuuaagggcagacgcacucugguugggggucagcaaguuacucucccagccauacccucuaaaggcgucuuccugggugcaagcgggcgguuuguggagcugcagacggaguucgguuugcgggugagaugggauggugaccagcagcuguauguuacuguguccagcacauacucuggcaaacucugugguuugugugggaacuaugacggcaacagugacaaugaccaccugaaguuggacggcagcccagcaggagacaaggaggagcuggggaacagcuggcagacggaccaggacgaggaccaggagugucagaaguaccagguggugaauuccccgucuugugauucaucucugcagagcagcaugucggggccaggguucuguggacggcuggucgacacucauggcccauuugagacaugccugcugcacgugaaggccgcuuccuucuucgacagcugcaugcuugauaugugcggauuccaggggcugcagcaccugcugugcacacacauguccaccaugaccaccaccugccaggacgcaggccacgcugugaagcccuggagggaaccccacuucugcccaauggccugcccgcccaacagcaaguacucccugugugcgaagccaugcccugacaccugccauucaggauucuccggcauguucugcucagaccggugcguggaggccugugaaugcaauccgggcuucguccucaguggccucgagugcauaccucgcucccagugugggugccuccacccugcaggcagcuacuucaagguaggggagcggugguacaagccaggcugcaaagaguugugcgucugugaaagcaacaacagaauucgcugccagcccuggagguguagggcccaggaguucuguggccaacaggaugguaucuauggcugccaugcccaaggugccgccaccugcacagccucgggugacccccacuaccugaccuucgauggcgccuugcaccacuucaugggcaccugcaccuauguccugacccggccuugcugguccaggucccaagacagcuauuuuguugugagcgccaccaacgagaaccgcggggggauccuggaggucuccuacaucaaagccguccacgugacagucuuugaccucagcaucucacugcucagaggcuguaaggucaugcugaauggccaucggguggcccuaccuguguggcuugcacaaggccgggugaccauaaggcucagcagcaaccucguccuccucuacacgaacuuugggcuccaaguucgcuacgacgggagccacuugguggaagugacaguccccuccuccuauggcggccagcucugugggcugugugggaacuacaacaacaacagcuuggaugacaaccugcgccccgacagaaagcuugcaggcgauuccaugcagcugggggccgccuggaaguuaccugaauccucugaaccuggcuguuuccuuguggguggcaagcccuccagcugccaggagaacagcauggcagacgccuggaacaagaacugugcgaucuuaauaaacccucagggacccuucucucaaugucaccagguggugccuccccaguccagcuuugccaguugcgugcauggucagugugggaccaagggcgacaccacagcccugugccgcucccugcaggccuacgcgucccugugugcccaggcuggccaggccccugccuggcggaacagaaccuucugcccuaugaggugcccaccuggcagcagcuacagccccugcagcagccccugcccagacaccugcagcagcauaaacaacccgagggacugccccaaagcacugcccugugcugagagcugugaaugucagaaaggccacaucuugaguggaaccuccugcgugccccuuggccaguguggcugcacugacccagcgggcuccuaccacccggucggggagcgcugguacacagagaacaccugcaccaggcucugcaccugcuccguccacaacaacaucaccugcuuccagagcaccugcaaacccaaccagauaugcugggcccuggaugggcugcuccguuucgggccucaggugugggagugugucagcucccaggggagucccacuacgugagcuuugaugguaguaaccauucuaucccggacgccugcacucuuguccuggugaaagugugccaccccgccauggccuugcccuucuucaagaucagugccaagcaugagaaggaggaagguggaacugaggcuuuccgccuucaugaggucuacauugacaucuacgaugcccaggucacccugcagaagggccaccgugugcuaaucaacagcaaacaggucacccuccccgccaucucccagaucccuggggucagugucaaguccagcagcaucuacagcauuguuaacaucaagaucggggugcaagucaaguuugacgggaaucaucucuuagagauugaaauccccacaaccuacuauggaaaggucugcggcaugugugggaacuucaaugaugaggaagaggacgaacuaaugaugcccagcgaugaaguagcaaauagugacagugaauuugugaacaguuggaaagauaaggacauugacccaaguugucagagucuccugguagaugagcagcagauuccagcggaacagcaggagaacccgaguggaaacugcagggcggccgaccuccgcagggcgcgggaaaagugcgaggcagcgcuccgggcuccugugugggcccagugcgccucccgcauagaccucacgcccuuccugguggacugugcaaacacccucugugaguucggaggucucuaccaggcccucugccaggcucugcaagccuucggggccaccugccagagccaggggcucaagcccccacucuggagaaacagcagcuucugcccucuggaaugcccugccuacagcagcuacaccaacugccuucccuccugcucacccuccugcugggaccuggauggccggugugagggcgccaaaguccccucugccugcgcugagggcugcauuugucagcccggcuaugugcugagugaagacaaguguguccccagaagucaguguggcugcaaggaugcccaugguggcuccaucccucugggcaagagcugggucuccagcgguugcacggagaagugugucugcacgggaggagccauucagugcggggacuuccgaugccccucugggucccacugccagcucacuuccgacaacagcaacagcaauugugucucagacaagucugaacaaugcucagucuauggcgacccccguuaccucacauuugacggcuucagcuaccgcuugcaaggccgcaugaccuauguucugaucaagacuguggacguacugccugaggggguggagccccuccucguggaaggacgcaacaagauggauccgcccaggagcuccaucuucuugcaggaagugauuaccaccgucuacggcuauaaagugcagcuccaagcuggucuggagcuuguggucaacaaccagaagauggccguccccuacaggccaaaugaacaccugcgggucacccuguggggccaacggcucuaccuggucaccgacuuugagcuggucgucagcuuugguggaaggaaaaaugcagugaucucccuacccagcauguacgaggggcuugugaguggccugugcggaaacuacgacaagaaccgcaagaaugacaugaugcugcccaguggcgcccugacccagaaccucaacaccuuuggcaacagcugggaggugaagaccgaggacgcacuccugcgcuuccccagggcuauaccagcggaggaggagggacaaggggcggagcugggccuccgcacgggccuccaaguguccgaauguagcccggagcagcuggcgagcaacagcacccaggccuguagggugcuggcagacccccagggccccuuugcugccugucaccagacgguggccccagagcccuuccaagagcacugcgugcuggaucugugcucugcucaggacccaagagagcaagaggagcugcguugccagguccucaguggguacgccauccucugccaggaggcgggcgcugcccuggcuggcuggcgggaccgcacccucugcgccauggaguguccagcagguaccauauaucagagcuguaugacacccugcccagcauccugugccaaccuggcagaccccggggacugcgagggccccugcguggaaggcugcgccagcaucccaggcuaugccuacaguggcacccagagccuccccuggcugacuguggcugcaccagcaauggcaucuacuaccagcugggcagcagcuuucugacugaggacugcucucagcggugcaccugugccagcucacggauccugcugugugagcccuucagcugcagagcgggggaggucugcacccuggggaaccacacccaaggcugcuuuccagaaagcccgugucugcagaaccccugucagaaugacgggcagugucgggagcagggagccaccuucaccugcgagugugaaguugguuacgggggaggccuguguauggagccucgagaugcgccaccucccagaaagccagcaucuaaccuggugggcguccuacugggacugcuggugccugugguggucguacuacuggccgugaccagagagugcauuuacagaacgaggaggaagagagagaaaacgcaggagggagacagacuggccaggcugguggacacagauacuguucuggacugugccuguuaaguugcucaguuuugagcugucuucagacaagaagauuaaauaaauuuauauauuuauuuauuuga

SEQ ID NO: 1321 - RNA, 3875 nt, Homo Sapiens
uuucagccaaccagacuggagcagcugcgagugcuacaucuuggcugucugaagcgauuggcuccucucuggggaguggaggguguucaguuauuaaugaccgcugagcaggcagcaccaugucagugugacaacugaucgggugaacgaugcaccacuaaccaccauggaaacaaggaaaaauaaagccagcucacaggaucucucuucacuggauugagagccucagccugccgacugagaaaaagaguuccaggaaaaagaaggaaucccggcugcagccuccugccuuccuuuauauuuuaaaauagagagauaagauugcgugcaugugugcauaucuauaguauauauuuuguacacuuuguuacacagacacacaaaugcaccuauuuauaccgggcaagaacacaaccaugugauuaucucaaccaaggaacugaggaauccagcacgcaaggacaucggaggugggcuagcacugaaacugcuuuucaaggaggugaagcauuccacagauaaucagcuacucuauucagggaaggaguguaaacaucaccacuuuuugcauguuugcauaaaaaaggcccacugaaucaguuaaaggccugaagcuccugggaucuaauucccugaggaacaauggaagaggcacuguuucccaacugguacaaaacaggacuucaggaacagcagaauguguucuccagggauuaagcccccuaacgugaagcuugggacucacaacacuuaacgaggaagaggaggagaaagagaaagaagaggaagauguugggcaacauuuauuuaacaugcuccacagcccggacccuggcaucaugcugcuauuccugcaaauacugaagaagcaugggauuuaaauauuuuacuucuaaauaaaugaauuacucaaucuccuaugaccaucuauacauacuccaccuucaaaaaguacaucaauauuauaucauuaaggaaauaguaaccuucucuucuccaauaugcaugacauuuuuggacaaugcaauuguggcacuggcacuuauuucagugaagaaaaacuuugugguucuauggcauucaucauuugacaaaugcaagcaucuuccuuaucaaucagcuccuauugaacuuacuagcacugacuguggaauccuuaagggcccauuacauuucugaagaagaaagcuaagaugaaggacaugccacuccgaauucaugugcuacuuggccuagcuaucacuacacuaguacaagcuguagauaaaaaaguggauuguccacgguuauguacgugugaaaucaggccuugguuuacacccagauccauuuauauggaagcaucuacaguggauuguaaugauuuaggucuuuuaacuuucccagccagauugccagcuaacacacagauucuucuccuacagacuaacaauauugcaaaaauugaauacuccacagacuuuccaguaaaccuuacuggccuggauuuaucucaaaacaauuuaucuucagucaccaauauuaauguaaaaaagaugccucagcuccuuucuguguaccuagaggaaaacaaacuuacugaacugccugaaaaaugucuguccgaacugagcaacuuacaagaacucuauauuaaucacaacuugcuuucuacaauuucaccuggagccuuuauuggccuacauaaucuucuucgacuucaucucaauucaaauagauugcagaugaucaacaguaagugguuugaugcucuuccaaaucuagagauucugaugauuggggaaaauccaauuaucagaaucaaagacaugaacuuuaagccucuuaucaaucuucgcagccugguuauagcugguauaaaccucacagaaauaccagauaacgccuugguuggacuggaaaacuuagaaagcaucucuuuuuacgauaacaggcuuauuaaaguaccccauguugcucuucaaaaaguuguaaaucucaaauuuuuggaucuaaauaaaaauccuauuaauagaauacgaaggggugauuuuagcaauaugcuacacuuaaaagaguuggggauaaauaauaugccugagcugauuuccaucgauagucuugcuguggauaaccugccagauuuaagaaaaauagaagcuacuaacaacccuagauugucuuacauucaccccaaugcauuuuucagacuccccaagcuggaaucacucaugcugaacagcaaugcucucagugcccuguaccaugguaccauugagucucugccaaaccucaaggaaaucagcauacacaguaaccccaucaggugugacugugucauccguuggaugaacaugaacaaaaccaacauucgauucauggagccagauucacuguuuugcguggacccaccugaauuccaaggucagaauguucggcaagugcauuucagggacaugauggaaauuugucucccucuuauagcuccugagagcuuuccuucuaaucuaaauguagaagcugggagcuauguuuccuuucacuguagagcuacugcagaaccacagccugaaaucuacuggauaacaccuucuggucaaaaacucuugccuaauacccugacagacaaguucuauguccauucugagggaacacuagauauaaauggcguaacucccaaagaaggggguuuauauacuuguauagcaacuaaccuaguuggcgcugacuugaagucuguuaugaucaaaguggauggaucuuuuccacaagauaacaauggcucuuugaauauuaaaauaagagauauucaggccaauucaguuuugguguccuggaaagcaaguucuaaaauucucaaaucuaguguuaaauggacagccuuugucaagacugaaaauucucaugcugcgcaaagugcucgaauaccaucugaugucaagguauauaaucuuacucaucugaauccaucaacugaguauaaaauuuguauugauauucccaccaucuaucagaaaaacagaaaaaaauguguaaaugucaccaccaaagguuugcacccugaucaaaaagaguaugaaaagaauaauaccacaacacuuauggccugucuuggaggccuucuggggauuauuggugugauaugucuuaucagcugccucucuccagaaaugaacugugaugguggacacagcuaugugaggaauuacuuacagaaaccaaccuuugcauuaggugagcuuuauccuccucugauaaaucucugggaagcaggaaaagaaaaaaguacaucacugaaaguaaaagcaacuguuauagguuuaccaacaaauauguccuaaaaaccaccaaggaaaccuacuccaaaaaugaacaaaaaaaaaaaaagcgaaagacugcaguugugcuaaaaacaaaacaaaacaaacaaacaaacaaaaaaguaaaaaaagauuacuuucgagagagaaguuuaagcuucaccaaugcugcuccugaccaauggaaauauguacaacuucagcauuuuaaguaacuggcuucaagggguacuguggcaaccaaauaaaauaacuccauuuucuaaaacuuucauguaacuuuuaugucuggacuacaguucaaguggacaaaaacauuucuguauuuuuuuuaaguaaauaagaguaguugaacugagcaauaccuccuccuguguuguauuacacauauuagccacgaguuuuugcagugaccagauaaacuugaauugacacgugguguaauaaaauggacaaauucuguagaguagacacagugaguauguggaccucuuuuauaaggaaaaauacauuuuggauuaaaaucaauugcuucugucuuguuuuguuucuaaauaaagaauaauuucugggaaa

SEQ ID NO: 1322 - RNA, 2500 nt, Homo Sapiens
aaauucugaaagguugccucaucgcuggaaauauguguaauguuggagcaaugcuagauuauaaaauuuaucguuaauuaauaaugaaacacacaaagauugagcaguuguugucaucagaaacaucuaccaggaacuuacagggggucaugagauagcucuacagcaaacaagaaagagaagaaaugcuucuugcccuggcagaauuauaagugggcacacuugcuauguuauacaauauuaggcaugcaguagaaaaaaacaaggaaccauacaaaucaccaggugucuggucacaaacucuggcagagcuucacaccaagcaggcaagcuacaagauuuggaacaacacagcuuauagaugaaaguuaaaggcauuuaauuuacuugaaaacagaggaagaaaggaccaacacauaaaagaacauucauuuugagggaugagcaauucaauugaguucaaggguagagcaauggugacuucucagccaccugcuaucaauuugacauguauuaagcacacgacuggguuaauaaaagugggaguuuggguuaaaaugcccuuugagaggcccugaaaaaauguuugucuaagaaaguugaaacuauggaagaaaagguggucaacuucagagacauagauguaacuccugcaacgugcuucaacaugguuuagccaagcggaaacuuuuucuuccuaguguaugcucuuuaacguauuuaagauguccuuaacaucuuucagaaaucuacuuuucuaccaauauuauauggguuaauauuuuucauagauaaagcacaaauaguagagggcuaauuuucagacuaugcugcauuuaugaagcaaagcaaaccucaucugcuuucaugacuugaauggaggagaaugguuagagacuauuaaaagaggagaggagaggaaagaagaggcaagagcaagaacauacagcagacuggcugcuccaacuuggcaguggucucucuaguuccuggaguccuguccaugaaugagguuggacuugcagccaccagccauugccaguggagaggcagcgccagacuccuaccagcacucacauggguggcaauggaaugaagucaccacauuuagcaaagggugauggcacauuucuuggguuugcuaugggaguaaccuucuguuuaaauguauuacacagagcucaucucuaacaaaaucaucuuccuauuugguuaacacuguaaaugaaaauucugaacaguguguguuuacgcaaagguagaaucuauacucucagacugcuauccauuugugugaccauaaagucuuuaaaacugaaguaacgauggggcagagagaggcaguauuuaauaucaaaaagccacaugguuguuacaauuuuaggcaagcuuaagcagaaauuguauauguaaggaauaaaaugucaauguuacuuucaguuugaauuucuaccacugaaauuuuaauucaauccaaaauauuccucugcacaugagucaggcagaaugaccaaauguugaugcugcgugaugaugauguccauagccuggaccucuucccaucuggcuccuuggauuaccucacagcccuuccuagguacccagaauguuugcucuuugguuauaaggccagaugaaugagcaaaaacucccaccuaaaucuguagcaugcggacaaccaaaugaauagauauuugauucuacucacagauaucaaacuaaauauguuaaauucuaaagagagcuauuucaacacucucaaucuucaaaauggaaaagcugcuucuguacuuauguaaaauauaauaugcuauguuauacuauuuguuacuucacaaaguuuuuaacacaucauuuuaacaccuccaagucuauaaauguauacugcagcagaagccauauugagcauauauaaucaaaaucgaauccuauauuccugcagcucucaccaccaucaaagcuugccaucuggagaaaacacagggcgaccguggccuacagauagaugcuuagagaauccaaccuucauccugagcaugaggguguuggcguuuggaaaagaggaagaaggggaagcaggcaaaugugggcuuggagagugacaaugcuaaugaaauaggguaaauaacaagcuuggaagugaagaccaggccaguuuccuagaacacuuuuccauucuguaucuugagacuauggagacaggaaguggagagagcagauaaauccaugacacuguacucuccgggaucagcuccugccauuccgacugcccuaauauccuuuccugccuccucucucuucuaguauugcucucagaucaugcuggauaugcuuaauauaaacugaauuuaucaucuucuagagauuccaauaucgacuuuaugucaauaaccucccaaaugccuguauuuuguucugaaguuuccucggggcaguauuuucagcucucuauuggccauaccacuuggaugaauaaaaagaacgucaaucuccauguguc

SEQ ID NO: 1323 - RNA, 7417 nt, Homo Sapiens
acagacacgugcuggggcgggcaggcgagcgccucagucuggucgccuggcggugccuccggccccaacgcgcccgggccgccgcgggccgcgcgcgccgaugcccggcugagucacuggcagggcagcgcgcgugugggaaggggcggagggagugcggccggcgggcgggcggggcgcugggcucagcccggccgcaggugacccggaggcccucgccgcccgcggcgccccgagcgcuuugugagcagaugcggagccgaguggagggcgcgagccagaugcggggcgacagcugacuugcugagaggaggcggggaggcgcggagcgcgcgugugguccuugcgccgcugacuucuccacugguuccugggcaccgaaagguaaaauugcagccccuuucagauccaguacccaaucccucgccucagggguucugcuuucuuuguuccccuaagagaccugacugcuguuccagggggcaaaaccacguaggguggugaugaagaguaaaucaaagaguuuagcagaaugcuucccauaugauaaaccucucauaaugaaggcccccgcugugcuugcaccuggcauccucgugcuccuguuuaccuuggugcagaggagcaauggggaguguaaagaggcacuagcaaaguccgagaugaaugugaauaugaaguaucagcuucccaacuucaccgcggaaacacccauccagaaugucauucuacaugagcaucacauuuuccuuggugccacuaacuacauuuauguuuuaaaugaggaagaccuucagaagguugcugaguacaagacugggccugugcuggaacacccagauuguuucccaugucaggacugcagcagcaaagccaauuuaucaggagguguuuggaaagauaacaucaacauggcucuaguugucgacaccuacuaugaugaucaacucauuagcuguggcagcgucaacagagggaccugccagcgacaugucuuuccccacaaucauacugcugacauacagucggagguucacugcauauucuccccacagauagaagagcccagccaguguccugacuguguggugagcgcccugggagccaaaguccuuucaucuguaaaggaccgguucaucaacuucuuuguaggcaauaccauaaauucuucuuauuucccagaucauccauugcauucgauaucagugagaaggcuaaaggaaacgaaagaugguuuuauguuuuugacggaccaguccuacauugauguuuuaccugaguucagagauucuuaccccauuaaguauguccaugccuuugaaagcaacaauuuuauuuacuucuugacgguccaaagggaaacucuagaugcucagacuuuucacacaagaauaaucagguucuguuccauaaacucuggauugcauuccuacauggaaaugccucuggaguguauucucacagaaaagagaaaaaagagauccacaaagaaggaaguguuuaauauacuucaggcugcguaugucagcaagccuggggcccagcuugcuagacaaauaggagccagccugaaugaugacauucuuuucgggguguucgcacaaagcaagccagauucugccgaaccaauggaucgaucugccaugugugcauucccuaucaaauaugucaacgacuucuucaacaagaucgucaacaaaaacaaugugagaugucuccagcauuuuuacggacccaaucaugagcacugcuuuaauaggguaggacccuccgagccaggugagggauauaaucucguggugcgccguuuuuuaagccgguccgaaaagcgcaauauucgggugggagugacccgauuuuccaggcagaaaaugugcuagauuggaggugaagacccuggagccagagagccuaggcuuaguccuagcccugcacugaagacacuucugagaaauucaucaggcugugaagcgcgccgugaugaauaucgaacagaguuuaccacagcuuugcagcgcguugacuuauucaugggucaauucagcgaaguccucuuaacaucuauauccaccuucauuaaaggagaccucaccauagcuaaucuugggacaucagagggucgcuucaugcagguugugguuucucgaucaggaccaucaaccccucaugugaauuuucuccuggacucccauccagugucuccagaagugauuguggagcauacauuaaaccaaaauggcuacacacugguuaucacugggaagaagaucacgaagaucccauugaauggcuugggcugcagacauuuccaguccugcagucaaugccucucugccccacccuuuguucaguguggcuggugccacgacaaaugugugcgaucggaggaaugccugagcgggacauggacucaacagaucugucugccugcaaucuacaagguuuucccaaauagugcaccccuugaaggagggacaaggcugaccauauguggcugggacuuuggauuucggaggaauaauaaauuugauuuaaagaaaacuagaguucuccuuggaaaugagagcugcaccuugacuuuaagugagagcacgaugaauacauugaaaugcacaguugguccugccaugaauaagcauuucaauauguccauaauuauuucaaauggccacgggacaacacaauacaguacauucuccuauguggauccuguaauaacaaguauuucgccgaaauacgguccuauggcugguggcacuuuacuuacuuuaacuggaaauuaccuaaacagugggaauucuagacacauuucaauugguggaaaaacauguacuuuaaaaagugugucaaacaguauucuugaauguuauaccccagcccaaaccauuucaacugaguuugcuguuaaauugaaaauugacuuagccaaccgagagacaagcaucuucaguuaccgugaagaucccauugucuaugaaauucauccaaccaaaucuuuuauuaguacuugguggaaagaaccucucaacauugucaguuuucuauuuugcuuugccaguggugggagcacaauaacagguguugggaaaaaccugaauucaguuagugucccgagaauggucauaaaugugcaugaagcaggaaggaacuuuacaguggcaugucaacaucgcucuaauucagagauaaucuguuguaccacuccuucccugcaacagcugaaucugcaacucccccugaaaaccaaagccuuuuucauguuagaugggauccuuuccaaauacuuugaucucauuuauguacauaauccuguguuuaagccuuuugaaaagccagugaugaucucaaugggcaaugaaaauguacuggaaauuaagggaaaugauauugacccugaagcaguuaaaggugaaguguuaaaaguuggaaauaagagcugugagaauauacacuuacauucugaagccguuuuaugcacgguccccaaugaccugcugaaauugaacagcgagcuaaauauagaggugggauuccugcauuccucucaugauguaaauaaggaagccaguguaauuauguuauucucaggcuuaaaauaaaucauuaaagcucauuuauguguggguuuuggcucaucaacucuggaagcaagcaauuucuucaaccguccuuggaaaaguaauaguucaaccagaucagaauuucacaggauugauugcugguguugucucaauaucaacagcacuguuauuacuacuuggguuuuuccuguggcugaaaaagagaaagcaaauuaaagaucugggcagugaauuaguucgcuacgaugcaagaguacacacuccucauuuggauaggcuuguaagugcccgaaguguaagcccaacuacagaaaugguuucaaaugaaucuguagacuaccgagcuacuuuuccagaagaucaguuuccuaauucaucucagaacgguucaugccgacaagugcaguauccucugacagacaugucccccauccuaacuaguggggacucugauauauccaguccauuacugcaaaauacuguccacauugaccucagugcucuaaauccagagcugguccaggcagugcagcauguagugauugggcccaguagccugauugugcauuucaaugaagucauaggaagaggcuuauauccuugggugaaauguguugcaucuacauauauauuuacaaacacaccuacguaccuauagugggcauuuugguuguguauaucaugggacuuuguuggacaaugauggcaagaaaauucacugugcugugaaauccuugaacagaaucacugacauaggagaaguuucccaauuucugaccgagggaaucaucaugaaagauuuuagucaucccaauguccucucgcuccugggaaucugccugcgaagugaagggucuccgcuggugguccuaccauacaugaaacauggagaucuucgaaauuucauucgaaaugagacucauaauccaacuguaaaagaucuuauuggcuuuggucuucaaguagccaaaggcaugaaauaucuugcaagcaaaaaguuuguccacagagacuuggcugcaagaaacuguaugcuggaugaaaaauucacagucaagguugcugauuuuggucuugccagagacauguaugauaaagaauacuauaguguacacaacaaaacaggugcaaagcugccagugaaguggauggcuuuggaaagucugcaaacucaaaaguuuaccaccaagucagaugugugguccuuuggcgugcuccucugggagcugaugacaagaggagccccaccuuauccugacguaaacaccuuugauauaacuguuuacuuguugcaagggagaagacuccuacaacccgaauacugcccagaccccuuauaugaaguaaugcuaaaaugcuggcacccuaaagccgaaaugcgcccauccuuuucugaacuggugucccggauaucagcgaucuucucuacuuucauuggggagcacuauguccaugugaacgcuacuuaugugaacguaaaaugugucgcuccguauccuucucuguugucaucagaagauaacgcugaugaugagguggacacacgaccagccuccuucugggagacaucauagugcuaguacuaugucaaagcaacaguccacacuuuguccaaugguuuuuucacugccugaccuuuaaaaggccaucgauauucuuugcucuugccaaaauugcacuauuauaggacuuguauuguuauuuaaauuacuggauucuaaggaauuucuuaucugacagagcaucagaaccagaggcuuggucccacaggccacggaccaauggccugcagccgugacaacacuccugucauauuggaguccaaaacuugaauucuggguugaauuuuuuaaaaaucagguaccacuugauuucauaugggaaauugaagcaggaaauauugagggcuucuugaucacagaaaacucagaagagauaguaaugcucaggacaggagcggcagccccagaacaggccacucauuuagaauucuaguguuucaaaacacuuuuguguguuguauggucaauaacauuuuucauuacugauggugucauucacccauuagguaaacauucccuuuuaaauguuuguuuguuuuuugagacaggaucucacucuguugccagggcuguagugcaguggugugaucauagcucacugcaaccuccaccucccaggcucaagccucccgaauagcugggacuacaggcgcacaccaccauccccggcuaauuuuuguauuuuuuguagagacgggguuuugccauguugccaaggcugguuucaaacuccuggacucaagaaauccacccaccucagccucccaaagugcuaggauuacaggcaugagccacugcgcccagcccuuauaaauuuuuguauagacauuccuuugguuggaagaauauuuauaggcaauacagucaaaguuucaaaauagcaucacacaaaacauguuuauaaaugaacaggauguaauguacauagaugacauuaagaaaauuuguaugaaauaauuuagucaucaugaaauauuuaguugucauauaaaaacccacuguuugagaaugaugcuacucugaucuaaugaaugugaacauguagauguuuuguguguauuuuuuuaaaugaaaacucaaaauaagacaaguaauuuguugauaaauauuuuuaaagauaacucagcauguuuguaaagcaggauacauuuuacuaaaagguucauugguuccaaucacagcucauagguagagcaaagaaaggguggauggauugaaaagauuagccucugucucgguggcagguucccaccucgcaagcaauuggaaacaaaacuuuuggggaguuuuauuuugcauuaggguguguuuuauguuaagcaaaacauacuuuagaaacaaaugaaaaaggcaauugaaaaucccagcuauuucaccuagauggaauagccacccugagcagaacuuugugaugcuucauucuguggaauuuugugcuugcuacuguauagugcaugugguguagguuacucuaacugguuuugucgacguaaacauuuaaaguguuauauuuuuuauaaaaauguuuauuuuuaaugauaugagaaaaauuuuguuaggccacaaaaacacugcacugugaacauuuuagaaaagguaugucagacugggauuaaugacagcaugauuuucaaugacuguaaauugcgauaaggaaauguacugauugccaauacaccccacccucauuacaucaucaggacuugaagccaaggguuaacccagcaagcuacaaagagggugugucacacugaaacucaauaguugaguuuggcuguuguugcaggaaaaugauuauaacuaaaagcucucugauagugcagagacuuaccagaagacacaaggaauuguacugaagagcuauuacaauccaaauauugccguuucauaaauguaauaaguaauacuaauucacagaguauuguaaaugguggaugacaaaagaaaaucugcucuguggaaagaaagaacugucucuaccagggucaagagcaugaacgcaucaauagaaagaacucggggaaacaucccaucaacaggacuacacacuuguauauacauucuugagaacacugcaaugugaaaaucacguuugcuauuuauaaacuuguccuuagauuaaugugucuggacagauugugggaguaagugauucuucuaagaauuagauacuugucacugccuauaccugcagcugaacugaaugguacuucguauguuaauaguuguucugauaaaucaugcaauuaaaguaaagugaugcaacaucuugua

SEQ ID NO: 1324 - RNA, 2571 nt, Homo Sapiens
ccaauaggcagagcccuaggaccugcccacgucugguucaggggcuagaaaagagcgucgaugccggcggcagugaugaguccuaggaggcgcuggcucuuuggcggcucggaggagcggcugcugcugcugcugcugcugcugguggccccuuugcagaaugagccucgcaggcagucaccguucugucaacugagaggaggagcccgcuuugguagugcuguccuuauggcaagaauauauagaaguuggagggaagauaaacucucuucuggaugucugagaaaaguucuaagaacagugcuguuggcucagugagaugagguuaucggaaaacuuucuguuuacacaagaguugccuccuucaaagaagcaugcaugguccuugcaggucacugugcccaucacucugcauaguccagcugcacucugcuucacacagcugccugcccauugcaggcauuugaguuugcaauccaugccuuaaacuuuaaaucacacuggcuacagcguuguguguuucuugguaaacacuggguaaaucagcuccuguggauguugacugaaguuucuauguuugcaagcuaauccucagcaguuucuuuacaaggagagagagaggcgggcugagcagccaugucagcagauucuccgaggauggagugggcccagcagaucuucaggccagcagcuuaaauguaaggaguucagcauagcuugagaguugcuggucucccuuuacuagauucucccccugcuaagacguagcugguguguguaggauaucuggagggcuggggaggaggagguggggccucuuuaucagugugguuccucucacuccugccuaccagaucuguuuguacaggcagcaucccucagcugcuugcauuugauagcuuauuuugcaucuggauuuauuccugcugaaaacucuaucuugagauguauugcuguccuugaauauuagcccauuugaaaacgccugggaaguucagccaucaguauguccaaguacaaacuuauuauguuaagacauggagagggugcuuggaauaaggagaaccguuuuuguagcuggguggaucagaaacucaacagcgaaggaauggaggaagcucggaacugugggaagcaacucaaagcguuaaacuuugaguuugaucuuguauucacaucuguccuuaaucgguccauucacacagccuggcugauccuggaagagcuaggccaggaaugggugccuguggaaagcuccuggcgucuaaaugagcgucacuauggggccuugaucggucucaacagggagcagauggcuuugaaucauggugaagaacaagugaggcucuggagaagaagcuacaauguaaccccgccucccauugaggagucucauccuuacuaccaagaaaucuacaacgaccggagguauaaaguaugcgaugugcccuuggaucaacugccacggucggaaagcuuaaaggauguucuggagagacuccuucccuauuggaaugaaaggauugcucccgaaguauuacguggcaaaaccauucugauaucugcucauggaaauagcaguagggcacuccuaaaacaccuggaagguaucucagaugaagacaucaucaacauuacucuuccuacuggaguccccauucuucuggaauuggaugaaaaccugcgugcuguugggccucaucaguuccugggugaccaagaggcgauccaagcagccauuaagaaaguagaagaucaaggaaaagugaaacaagcuaaaaaauagucuuucucaacuguuggcuaagaagaaaugcaaaagaaguggcauaggaguguguuaugggugcugaacucucucucuuuuuccccgauuuuccagagcuaggcuguggaguagaguuuguauagguaacuagguaacuuauuguggcccagauaaggcuuuaggaugccucagugcuuaugucauagccuuaugaguuagcuuucuugcuagcccccuagucggucaccaaacuaguaacuaguggggcuuaaugaaggucauaaguuucugagaugggagagcaacaaguagagaugaaguuaaagguauuuaucauucaagaaaucauuauugagucaccauugacaggcacuauucuaaucaguaguucacuuuaauauuuaauaagauuuucugggauaacaguaagggauauuagauaauauaccguauguauuuauuacuagucuuuuccucuaggaaaagggauacuuugauaauuaaggccagaggcccauuaguugagaaagucacagauauauuucuccaagaaagccaacaaccaccaccacaaugacagaaaugacaacaaggcccuuuaacuugucuucuaguuuagagacauccuucauuugacauuuaguagaauuccucuuuggccacaagaauaagcagcaaauaaacaacuauggcuguugagguucucauuuugguuuguuuuaauuuuuugaacuuuggguaccuguaauuaguuuaaaaauaaaguuccugauaauaaagugacugaaaauggcauccccaaa

SEQ ID NO: 1325 - RNA, 1921 nt, Homo Sapiens
uuucuucuggucaauccaucuaguguuaaugguucugaaacauggauuuuauugugucguauuucugccugaguagucaagcauucuucuuugccuacagaauaaauucugcauuuuuuuugacucauuuucagacucuuucaccaucuagucagaggcuguaaacuaguggccugugggccaguauaauccuacauccccuuuuccccccaucauuuuccuuuaucuucuaguagaaaucuucucguuccaguuaaguuguuccucuuuauuuucccgauaggaaauacuguauucuccucuugaagcaugugcucuggcucuuucccucuauuauuugucuucuguguaaauuaucuucacuuguccuagaaaccuccucauacacacugauauuuaauaaagauagcccucuuuugugaauuugcuugaaaauggaagcauuagaaguagguaaaguuaugagccaaggaaauaaguuauucauugaacaaauauugagcuguaauauaauauuauaucauauuauguaacaaaauauugaguaccuauuaugugguggacuguguuaucugauuggggcuguuacaaugaucaagaaagacuauguuccucccucauugagcuuauaucccauugcaaucaauaugcaaaaauaaguagguugacagccugccuucagagugcuuuuauaaacaucuuacuugaucugaacagcaauccugaaguacuugagaaaacagaaguucagcuggucucgaacuccuggccucuagugaucugcuugccucaggcucccauagugcugggacuacaggugugagccaccacgcccggccuggcuucauugauuuuuccaauuguaguaauaaucaugcucauugcuuauaauucaaccaguacuagaaaguucaaacaacccucauaguaauauagauuuguaaauuccaaaauucguauuuuauuaugucuuucuuugccaccuucucuuuucuccacuugguauaucaagaacaucauuuuuaaaggcuaaauagacacuguauggcuauuccauagcugaaucaaccaaaccucuguugagaggcucuuaaaauguuucuucuuguauaaaaaacaacauuguuaaacuuuauucuccauuuaucuuuuuauaauuauuucacucuuaauuccuuagaaauagaauuccuuagucaaauuaucagguuuauucaguagucaugguuugugcaaaaccuggucuucugggagggauaaguaagaaaaauggaccauuuuucuaaugaagcuuaagaguuuauuuggggaaauaacauucacuuuuggaauuucaaaagaaaaguuaaaaauucuugacgauuuaacuuuguuaccuuuguuaguaaaacaauauaaaaugcuguggagcuauaaguuaccaggaucagguauaguuauuugguccacauuucaugcaguaauggauucagaauggagaagacaaaaugcagaacugaacuuaauuacaaauaagcauuuuuuaaaaaaucuacaaucuaagcauuuagauguaaaaauauuaaaaaccaagaauaagcuuguggaaggaauuuaauuaugaaguaaacuacuugucuuuuuuugagauggaguuucgcucuuguugcccaggcuggagugcaauggugugaucuuggcucaccgcaaccucugccccccagguucaagcuauucugccucagccucccgaguaguugggauuacaggcaugcaccaccacgcccggcuaauuuuguauuuuuuuaguagagacgagguuucuccauguuggucaggcuguucucaaacucccaaccucaggugaucugcccgccucggccucacaaagugcuggaauuauaggcgugagcaacugcacccagcaacuacuuguuaaauu

SEQ ID NO: 1326 - RNA, 14164 nt, Homo Sapiens
ggguuaacacugggaaauaaaaacuucccacccacuucuugcaggaggcugugugguuacucccuaguaguaugguauacucugaggcuaaaauaaaacaaacccugucaacagacuaggccuuuuugaucagucagaaaugcucaguacuacagaagcggaccucaucucuauacuaacugaguuguuuccguaaaacugauccugucuccuggagauggcuagcauccagucccccagugcagaagaaagaagcucaguuucccaaaugggcaaggaccgcuacugguagacagauagggaauagauggguuggaagaaaggagaagagcagaacagagucaagugucagcguuugagcuauuccagggugaacccagcaaucucagguuuggucuuuugaagcaaaccaagauccccaggaaacuguggcauguucacguacuugccauugaacacagaguuguugauccaacgccaccuuuucucuucacgaugguaaauuaagccaauaaaauacuucucagcaucaguuauguccugaagaaacuucuggaaauaaaaaaaaaauuuuauuaaauccuguuacauuauacuucagcucuuaccauggccuugucauuggguugaacuggagcuguauuuuagauuuugccaacaauaacaagcgcugccaaguacuucagcugagaucacccaaauaauacucuacuagcaaaagcuuugcguggcguucuaaccaucagaaacugagaucuuugguugcuuugguggacugugcuccucugcuuuuauugcuaagccauccuucagacagagagggagcggcugcaagagguaaugagcaacauggauagaccuggaggcuauuuuuucugcgugaaaugacccagaaacagaaaguaaaaaacugcauguucucacuuauacacgagagauaaacaagauggcaagaaagaagcugaaaaaauuuacuacuuuggagauugugcucaguguucuucugcuuguguuguuuaucaucaguauuguucuaauugugcuuuuagccaaagagucacugaaaucaacagccccagauccugggacaacugguaccccagauccugggacaacugguaccccagauccuggaacaacugguaccacacaugcuaggacaacgggucccccagauccuggaacaacugguaccacuccuguuucugcugaauguccagugguaaaugaauuggaacgaauuaauugcaucccugaccagccgccaacaaaggccacaugugaccaacguggcuguugcuggaauccccagggagcuguaaguguucccuggugcuacuauuccaagaaucauagcuaccauguagagggcaaccuugucaacacaaaugcaggauucacagcccgguugaaaaaucugccuucuucaccaguguuuggaagcaauguugacaauguucuucucacagcagaauaucagacaucuaaucguuuccacuuuaaguugacugaccaaaccaauaacagguuugaagugccccacgaacacgugcaguccuucaguggaaaugcugcugcuucuuugaccuaccaaguugaaaucuccagacagccauuuagcaucaaagugaccagaagaagcaacaaucguguuuuguuugacucgagcauugggccccuacuguuugcugaccaguucuugcagcucuccacucgacugccuagcacuaacguguauggccugggagagcaugugcaccagcaguaucggcaugauaugaauuggaagaccuggcccauauuuaacagagacacaacucccaauggaaacggaacuaauuuguauggugcgcagacauucuucuugugccuugaagaugcuaguggauuguccuuugggguguuucugaugaacagcaaugccauggagguuguccuucagccugcgccagccaucacuuaccgcaccauugggggcauucucgacuucuauguguucuugggaaacacuccagagcaaguuguucaagaauaucuagagcucauugggcggccagcccuucccuccuacugggcgcuuggauuucaccucagucguuacgaauauggaaccuuagacaacaugagggaagucguggagagaaaucgcgcagcacagcucccuuaugccaggaacugauuaagaacucuauuuagagcccagaacagaguuguuuauccugaauaauaacagugaaaauuugauuucauuuuacuauggaaauuccuaggugcuaauuguggacuuuguauauucuuucaggauguucagcaugcugauauugauuauauggaugagagaagggacuucacuuaugauucaguggauuuuaaaggcuucccugaauuugucaacgaguuacacaauaauggacagaagcuugucaucauuguggauccagccaucuccaacaacucuuccucaaguaaacccuauggcccauaugacagggguucagauaugaagauaugggugaauaguucagauggagugacuccacucauuggggaggucuggccuggacaaacuguguuuccugauuauaccaaucccaacugugcuguuugguggacaaaggaauuugagcuuuuucacaaucaaguagaguuugauggaaucuggauuggauaugaaugaagucuccaacuuuguugaugguucggucucaggauguuccacaaacaaccuaaauaaucccccauucacucccagaauccuggauggguaccuguucugcaagacucucuguauggaugcagugcagcacuggggcaagcaguaugacauucacaaucuguauggcuacuccauggcggucgccacagcagaagcugccaagacuguguucccuaauaagagaagcuucauucugacccguucuaccuuugcgggcucuggcaaguuugcagcacauugguuaggagacaacacugccaccugggaugaccugagaugguccaucccuggcgugcuugaguucaaccuuuuuggcaucccaaugguggguccugacauauguggcuuugcuuuggacaccccugaggagcucuguaggcgguggaugcaguugggugcauuuuauccguuuucuagaaaucacaauggccaaggcuacaaggaccaggauccugccuccuuuggagcugacucccugcuguugaauuccuccaggcacuaccuuaacauccgcuauacucuauugcccuaccuauacacccucuucuuccgugcucacagccgaggggacacgguggccaggccccuuuugcaugaguucuacgaggacaacagcacuugggaugugcaccaacaguucuuaugggggcccggccuccucaucacuccaguucuggaugaaggugcagagaaagugauggcauaugugccugaugcugucugguaugacuacgagacuguaaguagcuuugacuuuucuucuacuccuuaagacuguagcugcagcugcauagacaagcuaccuuucuggagagagaaacauccaucuacaugcugaggaguaguuuuuaguguuuucuguaauuucauagcagaaccuggguaaaguuaaccuaaaccguuaacaucagucaugaugaaaugugaaaaaauaccuucauauacuuuauuuagcaauaagauaggcugacauaguaucucauaaauuaauauuggaggaacugauggagggagccaagugagauggaggaagcaaaaagucgagauggaacuuccuggagacaaaauuggacuucaccuucgaggaggcuacaucuuccccacacagcagccaaauacaaccacucuggccagucgaaagaacccucuuggucuuaucauugcccuagaugagaacaaagaagcaaaaggagaacuuuucugggauaauggggaaacgaaggauacuguggccaauaaaguguaucuuuuaugugaguuuucugucacucaaaaccgcuuggaggugaauauuucacaaucaaccuacaaggaccccaauaauuuagcauuuaaugagauuaaaauucuugggacggaggaaccuagcaauguuacagugaaacacaauggugucccaagucagacuucuccuacagucacuuaugauucuaaccugaagguugccauuaucacagauauugaucuucuccugggagaagcauacacaguggaauggagcauaaagauaagggaugaagaaaaaauagacuguuacccugaugagaauggugcuucugccgaaaacugcacugcccguggcuguaucugggaggcauccaauucuucuggagucccuuuuugcuauuuugucaacgaccuauacucugucagugauguucaguauaauucccauggggccacagcugacaucuccuuaaagucuuccguuuaugccaaugccuuccccuccacacccgugaacccccuucgccuggaugucacuuaccauaagaaugaaaugcugcaguucaagauuuaugaucccaacaagaaucgguaugaaguuccagucccucugaacauacccagcaugccauccagcaccccugagggucaacucuaugaugugcucauuaagaagaauccauuugggauugaaauucgccggaagaguacaggcacuauaauuugggacucucagcuccuuggcuuuaccuucagugacauguuuauccgcaucuccacccgccuucccuccaaguaccucuauggcuuuggggaaacugagcacagguccuauaggagagacuuggaguggcacacuugggggauguucucccgagaccagcccccaggguacaagaagaauuccuaugguguccaccccuacuacauggggcuggaggaggacggcagugcccauggagugcuccugcugaacagcaaugccauggaugugacguuccagccccugccugccuugacauaccgcaccacagggggaguucuggacuuuuauguguucuuggggccgacuccagagcuugucacccagcaguacacugaguugauuggccggccugugaugguaccuuacuggucuuugggguuccagcugugucgcuauggcuaccagaaugacucugagaucgccagcuuguaugaugagaugguggcugcccagaucccuuaugaugugcaguacucagacaucgacuacauggagcggcagcuggacuucacccucagccccaaguuugcuggguuuccagcucugaucaaucgcaugaaggcugaugggaugcgggucauccucauucuggauccagccauuucuggcaaugagacacagccuuauccugccuucacucggggcguggaggaugacgucuucaucaaauacccaaaugauggagacauugucuggggaaaggucuggccugauuuuccugauguuguugugaaugggucucuagacugggacagccaaguggagcuauaucgagcuuauguggccuucccagacuuuuuccguaauucaacugccaagugguggaagagggaaauagaagaacuauacaacaauccacagaauccagagaggagcuugaaguuugauggcauguggauugauaugaaugaaccaucaagcuucgugaauggggcaguuucuccaggcugcagggacgccucucugaaccacccucccuacaugccacauuuggaguccagggacaggggccugagcagcaagacccuuuguauggagagucagcagauccucccagacggcucccuggugcagcacuacaacgugcacaaccuguauggguggucccagaccagacccacauacgaagccgugcaggaggugacgggacagcgaggggucgucaucacccgcuccacauuucccucuucuggccgcugggcaggacauuggcugggagacaacacggccgcaugggaucagcugaagaagucuaucauuggcaugauggaguucagccucuuuggcauauccuauacgggagcagauaucuguggguucuuucaagacgcugaguacgagauguguguucgcuggaugcagcugggggccuuuuaccccuucucaagaaaccacaauaccauugggaccaggagacaagacccuguguccugggaugcugcuuuugugaauauuuccagaaauguccugcagaccagauacacccuguugccauaucuguauaccuugaugcaaaaggcccacacggagggcgucacuguugugcggccucugcuccaugaguuugugucagaccaggugacaugggacauagacagucaguuccugcugggcccagccuuccuggucagcccuguccuggagcgcaaugccagaaaugucacugcauauuucccuagagcccguugguacgauuacuacacggguguggauauuaaugcaagaggagaguggaagaccuugccagccccucuugaccacauuaaucuucauguccgugggggcuacauccugcccuggcaagagccugcacugaacacccacuuaagcagucgaaagaacccucuuggucuuauuauugcccuagaugaaaacaaagaagcaaaaggagaacuuuucugggaugaugggcaaacaaaggauacuguggccaagaaaguauaucuuuuaugugaguuuucugucacucaacaaguaguguuucuaaauauaguuuuuaauaaccacuuggaggugacuauuucacaaucaaccuacaaggaccccaauaauuuagcauucaaugagauuaaaauucuugggauggaggaaccuagcaauguuacggugaaacacaauggugucccaagucagacuucuccuacagucacuuaugauucuaaccugaaggucgccauuaucacagacaucaaucuuuuccugggagaagcauacacaguggaguggagcauaaagauaagggaugaagaaaaaauagacuguuacccugaugagaauggugauucugcagaaaacugcacugcccguggcuguaucugggaggcauccaauucuucuggagucccuuuuugcuauuuugucaacgaccuauacucugucagugauguucaguauaacucccauggggccacagcugacaucuccuuaaagucuucuguucaugccaaugccuucccuuccacacccgugaacccccuucgccuggaugucacuuaccauaagaaugaaaugcuacaguucaagauuuaugaucccaacaacaaucgguaugaaguuccagucccucugaacauacccagcgugccauccagcaccccugagggucaacucuaugauguccucauuaagaagaauccauuugggauugaaauucgccggaagaguacaggcacuauaauuugggacucucagcuccuuggcuucaccuucaaugacauguuuauccgcaucuccacccgccuucccuccaaguaccucuauggcuuuggggagacugagcacacguccuacaggagagacuuggaguggcacacuugggggauguucucccgagaccagcccccaggguacaagaagaauuccuaugguguccaccccuacuacauggggcuagaggaggauggcagugcccauggagugcuccugcugaacagcaaugccauggaugugacguuccagccccugccugccuugacauaccguaccacagggggaguucuggacuuuuauguguucuuggggccaacuccagagcuugucacccagcaguacacugaguugauuggccggccugugaugguaccuuacuggucuuugggguuccagcugugucgcuauggcuaccagaacgacucugagaucuccagcuuguaugaugagaugguggcugcccagaucccuuaugacgugcaguacucagacaucgacuacauggagcggcagcuggacuucacccucagccccaaguuugccggguuuccagcucugaucaaucgcaugaaggcugaugggaugcgggucauccucauucuggauccagccauuucuggcaaugagacacagcccuauccugccuucacucggggcguggaggaugacgucuucaucaaguacccaaaugauggagacauugucuggggaaaggucuggccugauuuuccugauguuguugugaaugggucucuagacugggacagucaaguggagcccaucuauguauguauguauguauguauguacguaucuaucuaucuaccuaucucagucuaucauaucuauguaucuaccgaucaauguauuaauucauccacccacucuaucuauccauccauccucuaucuaucuaucuaucaucuaccucaucuaucuauaucuaucuaucuaucuauccacucuaucuacucagguuauaucuaucuuucuaucugucugucuaucuaucuaucuaucuaucuaucuaucuaucuaucuauccauccagccacccuauucauuuaugucugucugucugucugucugucugucuaucuaucuaucuaucuaucuaucuaucuaucuaucuaucuaucuaucuaucauucuauccuaucuauguaccaucuaucuaucuaucuaucuaucuaucuaucuaucuaucuaucuaucuaaucuaucuccaccucuauucauccacucacccuaucuauccaaaucccucuucugucuaucauuuaucuaccuauuuauauaucaucuaucucuauguauguauguauguauguauguauguauguaucuaucuaucuaucuaucuaucuaucuaucuaucuauacuguucaagggagaagaccuagcuuccuguccucucgucaccucucacagagaaucacuugaagcuuagugguccaagcagcccacauggacacaggaaccugcccagccagagaaguucugggucaugggcuuccugacuuuuaucaaguagucaguaucagaaccccacaguucaucagccaguaggggcaacacugccauccugaggcaauuuggaaaucugagggcaguguugguuaucacagggacaccagaggcauucagugggcagugggcagggaugcccauagcucugauuucagggaauucuccacaaaauaucucucaccucaaacgccaguuauaccccugaugagaaacacuucauuagggagucacagaaucuguuagcucauaagaaauucuugguagauaggauaauuauaacuauugguugguacaaagguaauuguaguuuuugccauugaaaguuauuaaaaguaggccgggcaugguggcucaugccugcaaucccagcacuuugggaggcugaucacgaggucaggaguucaagaucaaccugaccaccauggugaaaccccaucuuuacuaaaaauacaaaaguuagccaggcgugguggcacgcgccuguaaucccacuuaggaggcugagguaggagaaucgcuugaacccgggaggcagagguugcagugagccaggauugagccacugcacuccagccugggugacacagcgagacuccgucucagaagaaaaaaaaaggaaggaaaguuauuaaaaguaaugacaaaaacuucaauuaccuuugcaccaaccuaauauuuauauuauuaauaaagacccacucgaugaagcuggugaggaugaagccacugauguccaggucuggcuuuacugaauauaaaacaaacagccaacagccccaugaaaagcagauuucugaguccaaagcuccagcaauuuaauucaauaagucugaugggaucuaggaauugcauuuuguagcaugcaaugugccacaaaaagagugcuaggugauccugaggcccagugugugggugguuauaucacuguuugaagacuggagaaagugaaggcagaagccacaaaggcaagacuugaauaugcacagguguaagguagagccagcacguuggagaacggcagaacauuuuuaugaaguuggaaggggucauccgagcaguacuuagggaaguuccuacaucauggcuggccaaguucaccacguguaccccauaugggauacaauucugacucagcuguggcugauaaucucuuuauucuaauucuccaucccccacccaucccgucguuucuaacccuuccugaucuggagcucucuguuucuggugaaagauucucuuugucagguuuccuagcuucuaccuccauuuccuaacaaaaggcaucccuggcaugcccacuucugucaagauucuccgugaugugacccacugucuucucacauccuugacagccagacccauguaggcuggucuguuucuguuuucucauguuccuuuucuugcccuuuauguagacauauggguuccuaccugccuuuugucuauuguguguaagaacuggaguuccccagaccaaguccucauucuguugccuccccgaaccuccucaccagcauucuuuagcucuuuaacucuuacaauggugugauugucauaaaggaggcuauuuacugagacauacaaaggaccauaauguuccguaacaagcaacauuuauuugcugcuucgaaguggugugaacccaccauuaaacagugaguauauauuuugugucaaguucuaagcuaagcauugugcaaaauauaaaugucacucagaugaauauaaaacaagcuucuugcucucaaaagucuacaauguaguuaagaaguuguaucuggcugggcauggugucucaugccuguuauccuaucacuuugggaggcugagguguguggaucacuuuaggucaggaauuugagaccagccugaacaacaugaggaaacuacgucucuacuagaaauacaaaaauuagccagguguaguggugugugccuguaaucccagcuacucaggaggcugaggcaaaagaaucgcgagaaccuggaaggcagagguuucacuauaucgagcuuauguggccuucccagacuuuuuccguaauucaacugccaagugguggaagagggaaauagaagaacuauacaacaauccacagaauccagagaggagcuugaaguuugauggcauguggauugauaugaaugaaccaucaagcuucgugaauggggcaguuucuccaggcugcagggaugccucucugaaccacccucccuacaugccguauuuggaguccagggacaggggccugagcagcaagacccugugcauggagagucagcagauccucccagacggcuccccggugcagcacuacaaugugcacaaccuguacggguggucccagaccagacccacauacgaagccgugcaggaggugacaggacagcgaggggucgucaucacccgcuccacauuucccucuucuggccgcugggcaggacauuggcugggagacaacacagccgcgugggaucagcugaagaagucuaucauuggcaugauggaguucagccucuucggcauauccuauacgggagcagauaucuguggguucuuucaagaugcugaauaugagauguguguucgcuggaugcagcugggggccuuuuaccccuucucaagaaaccacaacaccauugggaccaggagacaagacccuguguccugggauguugcuuuugugaauauuuccagaacuguccugcagaccagauacacccuguugccauaucuguauaccuugaugcauaaggcccacacggagggcgucacuguugugcggccucugcuccaugagugaguguccagcagggaucccaaugccuaauggaugacuuauugcauucuauauggugacaguugaauucuuccaaauuaaagacaugauugccuuuugacaugagcucuucaggugcagaccauacuuuauuacucucuuuagcacagugcuauacaugccuuaggucauuaauaaaagguuauugauugaaugagcaaaacugaaaugaugcaguauagcauagaauaauuucuuucuaauuuggcugugcaaaggccuaucuaucuuuuguagcaguuugguuauauguagccguuugugucagaccaggugacaugggacauagacagucaguuccugcugggcccagccuuccuggucagcccuguccuggagcguuggugcuaugucagcucagugcaaccucugccucccagguucaagugauucuccugccucaaccugccgaguagcuaggacuacaggcacgugccaccaggcccggccaauuuaaauuuuuuuuuuuauuuuuaguagaaacagcauuccaccauguuagucaggauggucuugaucuccugaccucaugauccgccugacucggccucccaaagugcugagaugacagacgugagccaccguguccagcccgcaaaucuuaugguacccacagaauuuuuuucugccccagacacaaccucaguuguuugucucuuuaagagggaauggcguaagccuauuucuauaagcaaauagugaauuuuuuuuuuucccgaaguccuggguaccaaagugcuuuaugaaagccacuuguuuugggguagacagaucucuccuguuugaaaaaggaaaagggauggaagguuuccucaauaggugaccuccugggacaugaggcaagugggcccaaggccaucacaauuauuuaaccucuuuccuaaguauuuugguuucucuguccuggaaaauggugccacugccacaccuuguuuauguuucauuuuagaaugccagaaaugucacugcauauuucccuagagcccgcugguaugauuacuacacggguguggauauuaaugcaagaggagaguggaagaccuugccagccccucuugaccacauuaaucuucauguccgugggggcuacauccugcccuggcaagagccugcacugaacacccacuuaagccgccagaaauucaugggcuucaaaauugccuuggaugaugaaggaacugcugggggcuggcucuucugggaugaugggcaaagcauugauaccuaugggaaaggacucuauuacuuggccagcuuuucugccagccagaauacgaugcaaagccauauaauuuucaacaauuacaucacugguacaaauccuuugaaacugggcuacauugaaaucuggggagugggcaguguccccguuaccagugucagcaucucugugaguggcauggucauaacacccuccuucaacaaugaccccacgacacagguauuaagcaucgaugugacugacagaaacaucagccuacauaauuuuacuucauugacguggauaagcacucugugaauuuuuacagcaagauucuaacuaacuaugaaugacuuugaaacuacuuauacuucauacucauaaaaauuauuguguguugcuaauuuguucauacccacuauuggugaaauauuucuguuaauuuuguuauauguuuuuugugugaacccuaaagguuaaaccuuagcccugugggauaggcaguuagggagguguggaaaaucuaugcauuaccuuaaugucucugugugguuaguaugguagugacuguucaucauaugacauuuacugaagaugaacuggguccaugaugaaguguguguauguccacguuuguaaucauagaauggaccccauucuuuuguuaaauacacaagagaaagcuuucugugacaguuccaggucuugaagcuaaucagcaucucaagaaaguauccagaaagaacaucugcuaguugguuauaggcggugggaggaauaauauaccuaauugguuauagguggggggagcaugauaagcaaagaaaaggcaaacacaaggaaagaucagaugaaacagaagaugauaguaaaagugauccuaaguaagaacauaauguaaaauugucagcagccucauggggaggaaaaaggaagagucaacucacuugaagaagagggucuugagaaauccuuagcauaaagggcuacuggugagauugagaucugagcaggcaaagcucaaaagagaguuuggagguuaaaaauaauuuauuuuugcaguagugugcuuugaaauguguaaaucuuauuucuaauguauacaaccacauuucacauaaaaauaugcaauuuauaugccagauaaaaauaaaacaagugaauuugcaaguga

SEQ ID NO: 1327 - RNA, 118 nt, Homo Sapiens
gaguucuggaucacuuacuuuuugcaagaacucucugcauggacacggaguuucaugggggccuucauuaugacauccacagcuuguauggccacuccauggcaagaaccacaaacuu

SEQ ID NO: 1328 - RNA, 125 nt, Homo Sapiens
ggaguggccaucucauggaggaaacaguuggugaauaugcuucucccaggugacaagauaggacuucaucugcgagggggcuacauauuucccacucagaagccaaacacaaccacagaagccag

SEQ ID NO: 1329 - RNA, 89 nt, Homo Sapiens
ccggaggaauucccugggacucaucaucgccuuggacuauaagagagaagcaaagggggagcuguacugggaugacgguguaucuaaag

SEQ ID NO: 1330 - RNA, 391 nt, Homo Sapiens
agaccagaauccugcccugggccuugccuggucugccucacucugccaugggcugcaggcuccucugcuguguggucuucugccuccuccaagcaggucccuuggacacagcuguuucccagacuccaaaauaccuggucacacagaugggaaacgacaaguccauuaaaugugaacaaaaucugggccaugauacuauguauugguauaaacaggacucuaagaaauuucugaagauaauguuuagcuacaauaauaaggagcucauuauaaaugaaacaguuccaaaucgcuucucaccuaaaucuccagacaaagcucacuuaaaucuucacaucaauucccuggagcuuggugacucugcuguguauuucugugccagcagccaaga

SEQ ID NO: 1331 - RNA, 652 nt, Homo Sapiens
cucagaggaccaguaucccucacagggugacaccugaccagcucugucccaccuggccaugggcuccagguaccucugaugggaagaccuuugucucuugggaacaagugaauccuuggcacaggcccaguggauucugcugugcagaacagagagcaguggaccucaggaggccugcaaggggaggacauaggacagugacaucacaguaugccccucccaccaggaaaagcaaggcugagaauuuagcucuuucccaggaggaccaagcccugagcacagacacagugcugccugccccuuugugccaugggcuccaggcugcucuguugggugcugcuuugucuccugggagcaggcccaguaaaggcuggagucacucaaacuccaagauaucugaucaaaacgagaggacagcaagugacacugagcugcuccccuaucucugggcauaggaguguauccugguaccaacagaccccaggacagggccuucaguuccucuuugaauacuucagugagacacagagaaacaaaggaaacuucccuggucgauucucagggcgccaguucucuaacucucgcucugagaugaaugugagcaccuuggagcugggggacucggcccuuuaucuuugcgccagcagcuugg

SEQ ID NO: 1332 - RNA, 455 nt, Homo Sapiens
aggagcagugacaucacaggaaaaaccaccaaccaaggccaaggagaccagagcccagcaccucacccagaggaccccagucagaggccccaucucagacccgaggcuagcaugggcugcaggcugcucugcugugcgguucucugucuccugggagcgguccccauggaaacgggaguuacgcagacaccaagacaccuggucaugggaaugacaaauaagaagucuuugaaaugugaacaacaucuggggcauaacgcuauguauugguacaagcaaagugcuaagaagccacuggagcucauguuugucuacaacuuuaaagaacagacugaaaacaacagugugccaagucgcuucucaccugaaugccccaacagcucucacuuauuccuucaccuacacacccugcagccagaagacucggcccuguaucucugugccagcagccaaga

SEQ ID NO: 1333 - RNA, 413 nt, Homo Sapiens
gucaucccuccucgcuggugaauggaggcaguggucacaacucuccccagagaagguggugugaggccaucacggaagaugcugcugcuucugcugcuucuggggccaggcuccgggcuuggugcugucgucucucaacauccgagcaggguuaucuguaagaguggaaccucugugaagaucgagugccguucccuggacuuucaggccacaacuauguuuugguaucgucaguucccgaaacagagucucaugcugauggcaacuuccaaugagggcuccaaggccacauacgagcaaggcgucgagaaggacaaguuucucaucaaccaugcaagccugaccuuguccacucugacagugaccagugcccauccugaagacagcagcuucuacaucugcagugcuagaga

SEQ ID NO: 1334 - RNA, 364 nt, Homo Sapiens
auucuuucuucaaagcagccaugggaaucaggcuccucugucguguggccuuuuguuuccuggcuguaggccucguagaugugaaaguaacccagagcucgagauaucuagucaaaaggacgggagagaaaguuuuucuggaauguguccaggauauggaccaugaaaauauguucugguaucgacaagacccaggucuggggcuacggcugaucuauuucucauaugauguuaaaaugaaagaaaaaggagauauuccugagggguacagugucucuagagagaagaaggagcgcuucucccugauucuggaguccgccagcaccaaccagacaucuauguaccucugugccagcaguuuaug

SEQ ID NO: 1335 - RNA, 50 nt, Homo Sapiens
agccaaaaacauucaguacuucggcgccgggacccggcucucagugcugg

SEQ ID NO: 1336 - RNA, 5596 nt, Homo Sapiens
gcggaggggcccugccccuccuccgggaaggugugucccuguuuccucaccugaaacuuccuaggagaacccgaucccucccucccgucgggcggccaggggcgggccgcggguggggcggccgggccugcgcuggggacggcucuggggacugcggccggcgccgggaccuggaggggacgcuggggccgaagcagcaugugacaccgaccaggauucagcccugauggaggcugaggaggcccagcguggagccucuccucccaucucugccauagaggaauucagcauuaucccugaggcucccaugaggagcagccaggucucugccuuggggcuugaagcucaagaagaugaggacccauccuauaaguggagagaggaacacagacucucagcaacucagcagagugaguuaagggaugugugugacuaugcgauugagacgaugcccucuuuucccaaggaagguucugcagauguggagcccaaucaggaaagccuuguggcugaggccugugacacuccggaacacugggaggcaguaccccagagccuagcaggccgacaagcaaggacucuagcucccccagagcucugggccugccccauucagagugagcaucuagacauggccccauuuuccagugaccugggaagcgaagaagaggagguggaauuuuggccaggacuuacuucuuugacauugggaucuggacaggcagaagaagaagaggaaaccucuucagauaacucuggucagaccagauauuauucucccugcgaagagcauccugcagagaccaaccagaaugaaggcucugaaagugggacuaucaggcagggggaagagcugccaccugaggagcugcaggaaagucaagggcucuugcauccccaggagguccaaguucuggaggagcagggacagcaggaagcaggauuucggggggaaggaacucugagggaggauguuugugccgaugggcuauuaggggaggaacagaugauagagcagguuaaugaugaaaagggagaacagaagcaaaaacaggaacagguacaagaugugaugcuugggagacaaggagaaagaauggggcucacuggggagccagagggucugaaugacggugagugggagcaggaggauauggagaggaaggcucagggucagggagguccagaacagggagaagagaggaagagggagcugcaggugccagaagagaauagggcggacucucaggacgaaaagagucaaaccuuuuugggaaaaucagaggaaguaacuggaaagcaagaagaucaugguauaaaggagaaaggggugccagucagcgggcaggaggcgaaagagccagagaguugggaugggggcaggcugggggcagugggaagagcgaggagcagggaagaggagaaugagcaucaugggccuucaaugcccgcucugauagccccugaggacucuccucacugugaccuguuuccaggugccucauaucucaugacucagauucccgggacucagacagaguccagggcugaggaacugucccccgcagcucugucucccucgcuagagcccaucaggugcucucaccagcccauuucucuacugggcuccuuuuugacugaggagucaccugacaaggaaauagaucaaaacagccagcaagaggaauccaggcugaggaagggaacaguguccagccaagggacugagguggucuuugccagugcaucugugacuccuccaaggacaccagauucagcuccucccaguccugcugaagccuaccccaucacaccugccucgguaucugccaggcccccaguugccuuucccaggagggaaaccucuugugcugcacgugcuccagaaacugccagugccccucucucaauggaugacccaucucccugugggacuucugagaugugcccggcugcccucuauggcuuccccuccaccgggaccagcccuccgaggcccccagccaacuccacaggcaccguccagcacuuacggagugacuccuucccugguucucacaggacagagcagacuccagaccuggugggaauguugcuuuccuacucccacucagagcugccccagaggccccccaaaccugccaucuacagcucugugaccccaagaagggacagaaggagugguagggacuacagcaccguuucagcauccccuacugccuuauccacgcugaagcaggacucucaagaauccaucucaaaucuagagagacccagcaguccucccagcauccagcccugggucuccccacauaauccagccuuugccacagagucucccgccuacgguucuuccccauccuuugucuccauggaggaugugaggauccacgaaccucugcccccuccucccccacagaggagggacacccaucccuccgugguggagacagauggccaugcucguguagugguucccacgcugaagcagcauagccacccuccuccauuggcccuagguucagggcugcaugccccccauaaaggcccacuuccccaagccucugaccccgcuguggccaggcagcaccgaccucugccaucuaccccagacagcucccaccaugcucaggccacccccagguggagauacaacaagccgcuacccccuaccccugauuugccgcagccccaccuuccucccauuucugcuccugguagcucaaggaucuacaggccucuacccccacuacccaucauagacccucccaccgaaccacccccauugcccccaaaguccagggggaggagcaggagcacucggggaggacauaugaacucagggggucaugccaaaacaagaccugcuugucaagacuggacagucccccucccugccucugcuggacgcaccuccuggcccccggccacagcuagaucaacagagucuuucacuuccaccagcaggaguaagagcgaaguguccccuggcauggcuuucagcaacaugacaaacuuccuaugccccucuuccccuaccacucccuggacuccggagcuccagggacccaccucuaaggaugaagcaggggucucagaacacccugaggccccugcgagagaaccuuugagaaggacaaccccucagcaaggagccaguggcccagggaggucaccugugggccaagcaaggcagccagaaaaacccagccaucugcaccuggagaaggcguccagcuggccccacaggcgggacucagggaggccaccaggggacagcaguggacaggcuguggcuccuagugagggggccaacaagcacaagggcuggagccggcagggccugcgcagaccuuccaucuugccugagggcucuucagauucaagagguccagccguggagaaacauccgggacccucagacacuguuguuuuucgggagaaaaaaccaaaggaggugaugggaggcuuuucaagacgcugcuccaaacucaucaacuccucccagcugcuuuaccaggaguauagugauguuguccugaauaaggagauccagagccagcagcggcuggagagccuguccgagacacccgggccuagcucuccgcggcagccucggaaggcccuggucuccuccgagucguaccugcagcggcucuccauggccuccagcggcucccucuggcaggaaauccccguggugcgcaacagcaccgugcugcucuccaugacccaugaagaccaaaagcugcaagaggucaaauuugagcugauugugucagaggccuccuaccugcgcagucuaaacauagcuguggaucauuuccaacuuucaacuucacuccgggccacacuuuccaaccaggagcaccaauggcucuucucucguuuacaggaugugcgagacgucagcgccacguuccuuucagaccuggaagagaacuuugagaacaauaucuucuccuuccaaguaugugacguaguccugaaccacgccccagacuuccgccgggucuaccugccuuaugucaccaaccagaccuaucaggaacgcaccuuccagagccugaugaauagcaacagcaauuuccgggaggucuuggagaagcuggagagcgaccccgucugccagcgccuuucccucaaguccuuucugauucugcccuuccaacgcaucacccgccucaaacugcugcuccagaacauucugaagagaacacagccuggcuccucggaggaggcagaggccacgaaggcacaccacgcccuggagcagcugauccgggacugcaauaacaauguccagaguaugcgacggacagaggaacuaaucuaccugagccagaagauugaguuugagugcaaaauauucccgcucauuucucagucacgcuggcuggugaaaaguggggagcugacagccuuggaguucagugcuuccccagggcuacgaaggaagcugaacacgcguccaguccaccugcaccucuucaaugacugucugcugcugucucggccccgagaggguagccgauuccugguauuugaccaugcucccuucuccuccauucggggggaaaagugugaaaugaagcuacauggaccucacaaaaaccuguuccgacucuuucugcggcagaacacucagggcgcccaggccgaguuccucuuccgcacggagacucaaagugaaaagcuucgguggaucucagccuuggccaugccaagagaggaguuggaccuucuggaguguuacaacuccccccagguacagugccuucgagccuacaagccccgagagaaugaugaauuggcacuggagaaagccgacguggugauggugacucagcagagcagugacggcuggcuggagggcgugaggcucucagacggggagcgaggcugguuuccugugcagcagguggaguucauuuccaacccagagguccgugcacagaaccugaaggaagcucaucgagucaagacugccaaacuacagcugguggaacagcaagccuaagucuucucugagaggaguuucgugagcugaagaacaagcugcucauggcaagggcuggccccagaacccugcaagagaggccuucuguggauggagaacuaggccuucucaaagcucaaggacaaaauccagcuaacccagucccucggcccaggccuccuuucgugcuuugugcuuggugggggggauuucgagggacuuugcacuggacucugggaaccuuucaucauuaaaaaaagggggaccauuggggccugagccaaggaacuuuccuucuacugccuuauagugcuuaaacauucuccgccuccagggugcagauucagagcuggccagaguuucagugauagccguauguuaaacagaaucucaccucagucuccuggagggagauguuuaagagggguuaacacaucagaugggagggucagcccggugaccucuaagguaucuucuaaccuagaaauucaccauaauuauggugcaaggucagugugucucugagaucuaugucuguugguggcaaugugagggugauacucucucacucuaauaaacuuggcacuucuccgagua

SEQ ID NO: 1337 - RNA, 3479 nt, Homo Sapiens
ggccccgcccaggcugcgcgguuucccgaaaccagcugcggcccgggggcccggcaaaggggguuccgcccggaggagcggaccgggcgggagaagaccgagcccccgcgcgcccccugcgcucccacucgcgcacacuugcacgccggcccuggccgggcggggcuggaggcgagaacgaccccacgggcuuucccagggccguccgcccgcggacccucccagcuccccagagcccagugacccucgcgcagcaggagaaccccagacggaccccaggcccugcagccugucaugaacccgaggggcugaaguucagccccacccccgccuccccuccccgccucccccuccaacucucaacccacuucuccagccagcgccccagcccucccgccgcccgcucgcaggucccgaggagcgcaggugaggcggcaccccacucccggcggcccccgggccuccuuccgcacgcaccccgagcugccuccgcacaguuggaggagcguaggagggacccccacccagggaugacacuccaggaaggggacugcagaggaagccagagacugugucccugacaaugggaacagccgacagugaugagauggccccggaggccccacagcacacccacaucgaugugcacauccaccaggagucugcccuggccaagcuccugcucaccugcugcucugcgcugcggccccgggccacccaggccaggggcagcagccggcugcugguggccucgugggugagugugacggccugccucgucgggcggcgggaggaacuccccaccuccagccgcagcagcacucucugccagccucccucugaacaggacaccgagccaguuaugucuucuuacuuagcgaugugauucucuggccuucucaguaagagccuggggaggggaggcucugggcugaagggguguggaggagccacugaccaugcagagucccaaucaguggagcccugaguccauccuuuccucugggccaaacucaggaugggccggcucuccucuccuuccuuucccuucucuuuucuccuccuccugccucuucuucuuucuccuucuccuccucuuucuucuccuuuucucuucucuucucuucucuucucuucuuucuuucucucucucucuaccucucccucucuuuuugggguuuuagcgguuaaucccugcaguggcagguccaccuaggagccgggaucuuggguccuuugucuuucaggugaugcagaucgugcuggggaucuugagugcaguccuaggaggauuuuucuacauccgcgacuacacccuccucgucaccucgggagcugccaucuggacaggggcuguggugaguagagcaggacagugcuugacugccugugagagggguggggcauugcucuccugauugccuuccuccaacauggcgccacagaaugcuggcagucggagagaucugauuaucuaggaccauucccugccuguucagaugagcaaacagcugagggcggugguggcauguccuauucacacugucugcucucccauacccuucccagugcuguucccaccaggcuggcugccucucccugccuucaacaguuaaugucaacuaaggaucuaaggaccugcucaucuccagauacuugcauugagauggggaaggcagagcguuccagauaguauguggucccccaggaagcaucacccccugguuauucucauuguccuccacaggcccuguacacaauggaaacccaggaauuguugucaacagaugggugugugcaguuugcacaggagcuggguaggcuggucaugguaccuacacucucagaauagcacuaaaacacucauauuuacugacagaagccgagaguaauuaccuucacccagccuguggcaaaauacccagcuuaauuacagaauuagccaaacaggauucagguccaccuguccacugggacauacuagauuuccuguucuucaagcccagcugaguggauuauugggcacuguuaggacaggcuucuagaccuaacagugcccacucuguauagacucacccuucauugagaucuucuccagcaccccaugacuuuuauccacaggaucccaccaucccuagaacuuucauaaagcacuugguguuguuuaaaaaggaagguuuagaagggaagaggggcucacaccuggcuugaccacaagcucuuaggugucacuaaagcagggccuuuugcagccucaggaguuggauccaggcuccacccucucagcaauuaucuuaccauggauaauaaagcuuagcaugaaaccucccgcccaagcugugugcuggggaagggccugcauggaggcucucucgugggagaggaguugcauuuccuguacuaagccugcuccuggcucaaucucuccccaggcugugcuggcuggagcugcugccuucauuuacgagaaacggggugguacauacuggguaaguucagggaagggcaugggaggggaccagguucaggcuggaggucaccccaaucuccugcccuguugcaggcuucucugggccuugcccuuuuuucccccgacuggacucugagagagacugaaacacaaagauuucucucugccuccucccuccccaggcccugcugaggacucugcuaacgcuggcagcuuucuccacagccaucgcugcccucaaacuuuggaaugaagauuuccgauauggcuacucuuauuacaacagugccugccgcaucuccagcucgagugacuggaacacuccagcccccacucagaguccagaagaagucagaaggcuacaccuauguaccuccuucauggacaugcugaaggccuuguucagaacccuucaggccaugcucuugggugucuggauucugcugcuucuggcaucucugaccccucuguggcuguacugcuggagaauguucccaaccaaaggggugagucccuaaggugugugccuguguauuuggggcaguggaacugcucaaaggagacaggaauggacaguggacaguuuggggaggagaaaggggcccaugacccaagucccaccuauuaucaugccugucuuucuacccagugguggcccagcccagaaagccccuauccccaaccaaguggcccccaagucaaagagcccaggaauaaaagagaccagaaggaaauguuggaagugaguggaaucuagccaugccucuccugauuauuagugccuggugcuucugcaccgggcgucccugcaucugacugcuggaagaagaaccagacugaggaaaagaggcucuucaacagccccaguuauccuggccccaugaccguggccacagcccugcuccagcagcacuugcccauuccuuacaccccuuccccauccugcuccgcuucauguccccuccugaguagucaugugauaauaaacucucauguuauuguucccagg

SEQ ID NO: 1338 - RNA, 4075 nt, Homo Sapiens
aacugcagcccccucucgcgccgccugcgaagacaaggucaguggccgcgaaguuggaacgugaucggagccacgaggcccagugaggcggcaccgagggggcagcgcaacgcgcucccccuguccagggcgucaagugcgccccucccggggcccgccugugcuccgggcggagcgcgcuagcugcucgggcgcggggcguucuuggugcgccgggccguggugaguccgggcucccguggccgcgugcugggaggagacuggagcccgguuaggaagaauggaguuggcgacucgcuaccagacuuguuuuauugagagucgcgagacucacugcuuccaccuugcuuccgacugguguuuacuuuccuccaccugcgugccuggcccgggagaaggggaggcggggccgccagcguuggaaggcgcagagugcccggcgcccgagcccaaaccgcugucaccugcccgagucuggcggcaaagacugagccacuaacgagcacuucgcaggcauaguuuggaagucaucagggcugguucuuuuccuuccagcagaucccuaaagaaguggcugacaucuuuaacgcccccagugaugaugaagaguuuguuggcuuccgagaugauguucccauggaaacccucucgucagaggagagcugcgauaguuuugacucacuagagucagggaaacagcaggaugugcgcuuucauuccaaauacuucacagaagagcuaagaagaauuuuuauagaggacacugacucagagacugaggauuuugcaggauuuacgcagagugaucugaauggaaagacuaacccagaaguaauggucguggagucagauuugagugaugauggcaaagcaucuuuggugagcgaggaagaggaagaugaagaagaagauaaggcuaccccuagaagaagcaggucuagaagaaguaguauuggucuucgaguagccuuucaguuccccaccaagaagcuggccaacaaaccagauaaaaacaguucuuccgagcaguuguuuucuagcgcacgcuuacagaaugagaaaaaaacaauucuugaaagaaagaaagacuguagacaggugauacaaagggaagauucuaccucugagucugaggaugacucucgggaugagagccaggagaguucagaugcuuugcugaaaaggaccaugaacaucaaggagaacaaagccaugcuugcccaguuauuggcggaauugaacucgaugccagauuucuucccaguacgaaccccaaccucagcuucuaggaagaagacagugaggcgggccuucucggagggacagaucacgcggcguaugaacccaacccggagugcgcggccuccugagaaguuugcucuagagaacuucacugucucagccgcuaaauuugcggaagaguuuuacagcuuccgaagaaggaagacaauuggguuugagaguuuaaaauauuuauaauuuuuuuauaacugcucaacacaucuccauguucugcuuguguucauugugcaggggaaaugccgggaguacagacgacgucaccguauaucuucuuuucggccaguggaggauaucaccgaagaggacuuagaaaauguugccauaacuguucgagauaaaaucuaugauaaaguucuggguaacacgugccaucagugucgacaaaagaccaucgacaccaagacagugugucggaaccaggguugcuguggugugcgaggacaguucuguggaccaugccugcggaaccgcuauggggaggaugucagaucggcauugcuggacccgguaggaacaguguuugcauuuguuguaaauuguauuggugaaggaagcaagcuauaaagaugggccuccuggguucucacugggaacuagggagcuccagaacucugguuuuucccuuccauuuguaucuuaaggcuccagggaaaaugaaaaauagggauuccuucuggaaggagagcaagcugaccagugaauagaagaauuaauguuguuagauuuuccauugucagagcaaaacuugcuuacaguccucuaguuuuaugcaaguaaucccuguaccuguccuucagcaaagugauuucccucugauuuguuuuguuuuuccugggccaggcugagagggagguggaggauuggguguguccccccugucgugggaucugcaauugcagcuacugucggaagcgugacggccgcugugccacaggaauccucauucaucuggccaaguuuuaugguuaugacaauguuaaggaauaucuggagagguaaguaagucucuagcagcuuacaaaacagcuugaaaucuugaggcugagcacaggagacccucugggcaaguaguuguugccuucccgugugacuuacuuacuuauauaaaccacgaguaccauccauucuguaucuguuugcauuggaaaagcucaggccugauauuuucccuauuagggaaucuucuccuuugcuagauuuuucaacucaacuccacguugccuuuaaccaaaauuucuccuugagguguaugacagaaauggaaggaacaaacaaacaaggcaggcugaggggaaagacacagauuaugaagaggcagccuuacaaaaggagcugguagaagacaauuaagaggaaaacaaacagaaccagccaccucaccauagaguacuccaacaagacaugcauaccauuggugccuaagaaagauuuuuuuacaguuguguuuuuauacagaaauucuuuguagaaauuacuauuuuuuguuaaagauuguuuauaugcuuacaaagauuucucaggaagacagcagagcagaggaaucuauauagauguaugcacagaccugucuguaugcugaacuuuguuaaaaauaucugccaguuauuaaaaagcacaguuuaaauggggugggguuaaaguucagguaaguaaguuagagagaaaacauuguaugaucagcuccugcacuugaucuaucuaucuuuggcuucccaaacaguaacucacuccaggccaagugugccuuagcacgagugaccacaguuuaauagaccacacacaucguuuaaccugcucuuggucauuggaaauuuacacugaacaaagugcaauuaacuguagaacaguuuuauuuuuauuaaaacuugacugaacaaaaggggaccaucaacauuguagacacuggacacuggaggccuuacagagugcuagccucuuccuucaggacucaccuggggccugcugcuuuuauauuuugaaagaguuuaagggcuaauaauuuaauuuguuguuuguuaaaaauuaaaaucuccguucuuuccggcugcauugcuuuugcauguucacauaugauguacuuuuaugauguacuuuuuuuuuuuugagauggagucuuguucuguugcccaggagggagugcaguggugcaaccucggcucacugcaaccuuugccuccuagguucaagugauucuccuaccuccugaguaacugggauuacagucgugugccaccacgcucagcccugaguuaguuucuaguauuuuuuucugacuuucacucuaaggauagcguugaaaaaagaaugcacgugugaguuacuaaaaaguuagaauaaugugcaugggaacagugcagcaacaugcuagaaaauccucacugcacuccagcagaggcuagaggaaugccaguguuaccuuacgcuucuagaagcagagccacuccagccagaacccauuuugcagucuucucuucgcucuucagccugaagguccagauguagcuggggccucucaguuugguucuauacacagggcacucguaggucuguuugguuucuugucuguccacggggguggcuuuugcaaagaugaccggcauagggcaugccagcuccuugagacgggcuucaacaaugguuccugcuugggugucccagcgggcgccuauggcaaaaacacagcgguugcaauuguguggcagcuugcuacuaaugauaaugaucaaguaaguuguuugaugcaauaaacauucaacauucugguuuugucaua

SEQ ID NO: 1339 - RNA, 97 nt, Homo Sapiens
ugaugcuuugcuggcuggugcagugccugagggaguaagaguccuguuguuguaagauagugucuuacucccucaggcacaucuccaacaagucucu

SEQ ID NO: 1340 - RNA, 97 nt, Homo Sapiens
agagacucgcuggagaugugccugagggaguaagacacuaucugacaacaacagggcucuuacucccucaggcacugcaccagccagcaaagcauca

SEQ ID NO: 1341 - RNA, 50 nt, Homo Sapiens
gaauuauuauaagaaacucuuuggcaguggaacaacacuuguugucacag

SEQ ID NO: 1342 - RNA, 50 nt, Homo Sapiens; identical to SEQ ID NO: 1341

SEQ ID NO: 1343 - RNA, 552 nt, Homo Sapiens
uucugggaggaaggcuugggaguccccuaagacacaucuucagucacuucucucugccugugacucaggaagaccagcuccuccuacugucuucugugcuagggaucacuuccuuguugaguggggccggaguuuuaagaggaucuucugcuccuccucaucuggucccuuuccuuccaaggcccccgagaggaaggcaugcggugggcccuacuggugcuucuagcuuuccugucuccugccagucagaaaucuuccaacuuggaagggggaacgaagucagucacgaggccgacuaggucaucugcugaaaucacuugugaccuuacuguaauaaaugccuucuacauccacugguaccuacaccaggaggggaaggccccacagcgucuucuguacuaugacgucuccaacucaaaggauguguuggaaucaggacucaguccaggaaaguauuauacucauacacccaggagguggagcuggauauugauacuacgaaaucuaauugaaaaugauucuggggucuauuacugugccaccugggacagg

SEQ ID NO: 1344 - RNA, 688 nt, Homo Sapiens
ggccugagcucuccuggccccuggcucucuucugcagagggccugcucucagcugccacaagagggcgccggagaacggaccugagcaagagaggcaggagcuccucugcagguccucccaggcaccaauccuucugggagggaggaaggcuugggaguccucuuagacagauccucagucacuucucucugcuugugucucaggaagaccagcuccuccuacugucuucugugcuagggaucacuuccuuguugaguggggccugaguuuuaagaggaucuucugcuccucuucaucuggucccuuuccuuccaaggccucagagaggaaggcaugcagugggcccuagcggugcuucuagcuuuccugucuccugccagucagaaaucuuccaacuuggaagggagaacgaagucagucaucaggcagacugggucaucugcugaaaucacuugugaucuugcugaaggaaguaccggcuacauccacugguaccuacaccaggaggggaaggccccacagcgucuucuguacuaugacuccuacaccuccagcguuguguuggaaucaggaaucagcccagggaaguaugauacuuacggaagcacaaggaagaacuugagaaugauacugcgaaaucuuauugaaaaugacucuggagucuauuacugugccaccugggauggg

SEQ ID NO: 1345 - RNA, 978 nt, Homo Sapiens
ucagguaccugaugcgaccuguccgcagccuccuccugcacugcucuuagcccugcagacgguggccaagcaguggaguggaaagcgugaccuaguggacagguguggccugcacggcguuugggccgcuguugcugugugcuggcacugcaaggcgggaugcuguaccccaaggagaguccgucgcgggagcccaaggagcuggguggccucuggagcuucccugccgauuuggacaaccgacgccagggcuuuaaggagaagugguacccgcggccacugcaggagucaggccccacccuggacgugcugguucccuucagcuucaacgacauuggccaggacuggcgccugcggcauuuuguuagcuggauguuguacgaaugggaggugacccugccggagaaauggacccaggaccugcgugcaagaguggugcugaggauuggcagugcccacuccuaugauaucgugguaucccaaggguuguuuuguccagaacacagacugacuucuucaacuacgcgggacugcaguggucugugcuucuguacacgacacccaccaccuacaucgaugacaucaccaucaccaccgguguggagcaugacaguggugagggcuucugcuguguccucucauuuuacuccagaccuuuugccugggcagagcauaaaacauuuauucccaaaagugauaaugagaagauaugaaagcuauggcauugaaaauuuaaaguuaaaagacuggaaaagcguggguuaguguacgggacagaaaaaaguuauaguggacuuaaccaauguuaaucuuucaaugugaugaauguggcaaagcuuuuaacuggugcuuaaucuuuauucaacauaagagaauuaauacaggagagaaaccauacaaaugugaggaauguggaaaagccuuuaacugguuuucaaaccuuauucgaaauaagagaauucguacuguagagaaacu

SEQ ID NO: 1346 - RNA, 1771 nt, Homo Sapiens
gcucuguguccucugcuccuagaggccaagccuauguguccuuguguccugcagguaucugcagauuuauggcuaaaagaccgggacccccuggaagccgggaaaugggacuguugacauucagagacauagcuauagaauucucucuggaggaauggcaaugccuggauugugcucagcggaauuuauauagacaugugauguuagagaacuacagaaacuuggucucccugguuacgcauucccauuucacccaagaccuucagccagagcagggcaucaaagauucacuccaaaaaguaauaccaagaacauauggaaaauguggacaugagaaauuacaauuuaaaaaaugcuguaaaagugugggugaaugugaggugcccaaagagguuauagugaaguuaaccaauguuugucaacuacccaaaacaaaauauuucagacucauaaauaugucaaagucuuugguaaauuuucaaauuccaauagagauaaaacaagauauacuggaaagaaacauuucaaauguaacaaauauggcaaaucauuuugcaugcuuucacaccuaaaucaacaucagguaauucauacuagggagaaguccuacaaaugcaaagaauguggcaaauccuuuaacugcuccucaaaccauacuacacauaaaauaauucauacuggagagaaaccauauagaugugaggaauguggcaaagccuuuagcugguccgcaaaccuuacuagacauaagagaauucauacuggagagaaacccuacacaugugaagaauguggccaagccuuuaggcgcuccucagcacuuacuaaccacaagagaauucauacuggagggagacccuacaaaugugaagaauguggcaaagccuuuagcguauccucaacccucacugaccacaagagaauucauacuggagagaaacccugcaggugugaggaauguggcaaagccuuuagcugguccucaaaccuuacuagacauaagagaauucauacuagagaaaacccuaugccugugaagaauguggccaagccuuuagcuuauccucgaaccuuacuagacauaagagaauucauacuggagagaaacccuacacauaugaagaauguggccaagacuuuaggcgcuccucagcacuuacuauccacaagagaauucauacuggagagagacccuacaaaugugaagaguguggcaaagucuuuagcuuauccucaacccucacugaccacaagagaauucauacuggagagagacccuacaaaugugaagaauguggcaaagccuuuagcuuauccucaacccucacugaccacaagagaauucacacuggagagagacccuacacaugugaagaauguggcaaagccuuuaauugcuccucaacccuuaugcaacauaagagaauucauacuggagagaaacccuacaaaugugaagaaugugaccaagcuuuuaaguggcauucaagucuugcuaaacauaagauaauucacacuggagagaaacccuacaaaugugaauaauguggcaaaguccacccucaggccuuauaauacauaaaauaauuuacacuggaaaaaaacacuacaaauguagagaauguggccaagccuuuaaccaguuccaaaccuuaauugaacguaagagaauucauauuggacagaaauuuuauaaauguaaaaaaauguaacaaagccuuuaaccaacccucaaaccuuaauaaaccuaagagaauuuauuuuaaaaaaa

SEQ ID NO: 1347 - RNA, 8958 nt, Homo Sapiens
aucccggggcagccgagggccccugacucggcuccucgcggcgacauggaucggauggccagcuccaugaagcaggugcccaacccacugcccaaggugcugagccggcgcggggucggcgcugggcuggaggcggcggagcgcgagagcuucgagcggacucagggucgcuguuggucuagccuugccucccgcauacccagucuagagccuggccacaugcccaucaaaagacucucacugcucugccugccuucuucuguccuggcgucuauacccucagaccagccuugcauaccuacuccugccagccuccuccaggaagccuugccuccucaacucuccugcaccauccucacauuucaccuggccacugucacugccagaggaggcaccacugaccugccucauggcccagccacugcacccaucuccaaccagacccuugguguguuccccacccaauccaucacaagccacuuucaagcuuuagggaagugaaaagucagcugcagaggagauacucggaggaggaggaaagagaagucacggagcccuguucuuaaccgaguuuugcagucaccuccccguauuccucucucacucugaagccgagcacagaacccagccucuggugguaccgagugaagguuggccugguugguuggauggauggccaaaugaacuccagaccacuggauuguauaacaggacagcaagaggcagcacagagccguggaaagaaccuguagccauaacauuugaugaaugaaucagacaugugacauuaguaauuggcucuccggaaccagccggggacacgagggccugcugggucaggaagugguggacaaugccacccuuucaggggagacacggcuuggucuuagguccugugugacuccagggaaguccagagaacagccuguucucagaugauguucccuaacccagagcccccuccagagacugucagcaucaauaaggccauuaauacgcaggaaguggcuguaaaggaaaaacacgccagaacgugcauacugggcacccaccaugagaaaggggcacagaccuucuggucuguugucaaccgccugccucugucuagcaacgcagugcucugcuggaaguucugccauguguuccacaaacuccuccgagauggacacccgaacguccugaaggacucucugagauacagaaaugaauugagugacaugagcaggauguggggccaccugagcgagggguauggccagcugugcagcaucuaccugaaacugcuaagaaccaagauggaguaccacaccaaaaaucccagguucccaggcaaccugcagaugagugaccgccagcuggacgaggcuggagaaagugacgugaacaacuuuuuccaguuaacaguggagauguuugacuaccuggagugugaacucaaccucuuccaaacaguauucaacucccuggacaugucccgcucuguguccgugacggcagcagggcagugccgccucgccccgcugauccaggucaucuuggacugcagccaccuuuaugacuacacugucaagcuucucuucaaacuccacuccugccucccagcugacacccugcaaggccaccgggaccgcuucauggagcaguuuacaaaaucuccuugacagccugugccuuugggcuggggagggggcaggaaagccagguggcugcucuguccccuacauggggcugaugaagacacccagcaccccucagguccuucuccaccccuagguugaaagaucuguucuaccgcuccagcaaccugcaguacuucaagcggcucauucagaucccccagcugccugagaacccacccaacuuccugcgagccucagcccugucagaacauaucagcccugugguggugaucccugcagaggccucaucccccgacagcgagccaguccuagagaaggaugaccucauggacauggaugccucucagcagaauuuauuugacaacaaguuugaugacaucuuuggcaguucauucagcagugaucccuucaauuucaacagucaaaauggugugaacaaggaugagaaggaccacuuaauugagcgacuauacagagagaucaguggauugaaggcacagcuagaaaacaugaagacugagagccagcggguugugcugcagcugaagggccacgucagcgagcuggaagcagaucuggccgagcagcagcaccugcggcagcaggcggccgacgacugugaauuccugcgggcagaacuggacgagcucaggaggcagcgggaggacaccgagaaggcucagcggagccugucugagauagaaaggaaagcucaagccaaugaacagcgauauagcaagcuaaaggagaaguacagcgagcugguucagaaccacgcugaccugcugcggaagaaugcagaggugaccaaacagguguccauggccagacaagcccagguagauuuggaacgagagaaaaaagagcuggaggauucguuggagcgcaucagugaccagggccagcggaagacucaagaacagcuggaaguucuagagagcuugaagcaggaacuugccacaagccaacgggagcuucagguucugcaaggcagccuggaaacuucugcccagucagaagcaaacugggcagccgaguucgccgagcuagagaaggagcgggacagccuggugaguggcgcagcucauagggaggaggaauuaucugcucuucggaaagaacugcaggacacucagcucaaacuggccagcacagaggaaucuaugugccagcuugccaaagaccaacgaaaaaugcuucuggugggguccaggaaggcugcggagcaggugauacaagacgcccugaaccagcuugaagaaccuccucucaucagcugcgcugggucugcagaucaccuccucuccacggucacauccauuuccagcugcaucgagcaacuggagaaaagcuggagccaguaucuggccugcccagaagacaucaguggacuucuccauuccauaacccugcuggcccacuugaccagcgacgccauugcucauggugccaccaccugccucagagccccaccugagccugccgacucacugaccgaggccuguaagcaguauggcagggaaacccucgccuaccuggccucccuggaggaagagggaagccuugagaaugccgacagcacagccaugaggaacugccugagcaagaucaaggccaucggcgaggagcuccugcccaggggacuggacaucaagcaggaggagcugggggaccugguggacaaggagauggcggccacuucagcugcuauugaaacugccacggccagaauagaggagaugcucagcaaaucccgagcaggagacacaggagucaaauuggaggugaaugaaaggauccuugguugcuguaccagccucaugcaagcuauucaggugcucaucguggccucuaaggaccuccagagagagauuguggagagcggcagggguacagcauccccuaaagaguuuuaugccaagaacucucgauggacagaaggacuuaucucagccuccaaggcugugggcuggggagccacugucaugguggaugcagcugaucuggugguacaaggcagagggaaauuugaggagcuaaugguguguucucaugaaauugcugcuagcacagcccagcuuguggcugcauccaaggugaaagcugauaaggacagccccaaccuagcccagcugcagcaggccucucggggagugaaccaggccacugccggcguuguggccucaaccauuuccggcaaaucacagaucgaagagacagacaacauggacuucucaagcaugacgcugacacagaucaaacgccaagagauggauucucagguuagggugcuagagcuagaaaaugaauugcagaaggagcgucaaaaacugggagagcuucggaaaaagcacuacgagcuugcugguguugcugagggcugggaagaaggaacagaggcaucuccaccuacacugcaagaagugguaaccgaaaaagaauagagccaaaccaacaccccauaugucaguguaaauccuuguuaccuaucucguguguguuauuuccccagccacaggccaaauccuuggagucccaggggcagccacaccacugccauuacccagugccgaggacaugcaugacacuuccaaagacucccuccauagcgacacccuuucuguuuggacccauggucaucucuguucuuuucccgccucccuaguuagcauccaggcuggccagugcugcccaugagcaagccuagguacgaagaggggugguggggggcagggccacucaacagagaggaccaacauccaguccugcugacuauuugacccccacaacaauggguauccuuaauagaggagcugcuuguuguuuguugacagcuuggaaagggaagaucuuaugccuuuucuuuucuguuuucuucucagucuuuucaguuucaucauuugcacaaacuugugagcaucagagggcugauggauuccaaaccaggacacuacccugagaucugcacagucagaaggacggcaggaguguccuggcugugaaugccaaagccauucucccccucuuugggcagugccauggauuuccacugcuucuuauggugguugguuggguuuuuugguuuuguuuuuuuuuuuaaguuucacucacauagccaacucucccaaagggcacaccccuggggcugagucuccagggccccccaacugugguagcuccagcgauggugcugcccaggccucucggugcuccaucuccgccuccacacugaccaagugcuggcccacccaguccaugcuccagggucaggcggagcugcugagugacagcuuuccucaaaaagcagaaggagagugagugccuuucccuccuaaagcugaaucccggcggaaagccucuguccgccuuuacaagggagaagacaacagaaagagggacaagaggguucacacagcccaguucccgugacgaggcucaaaaacuugaucacaugcuugaauggagcuggugagaucaacaacacuacuucccugccggaaugaacuguccgugaauggucucugucaagcgggccgucucccuuggcccagagacggagugugggagugauucccaacuccuuucugcagacgucugccuuggcauccucuugaauaggaagaucguuccaccuucuacgcaauugacaaacccggaagaucagaugcaauugcucccaucagggaagaacccuauacuugguuugcuacccuuaguauuuauuacuaaccucccuuaagcagcaacagccuacaaagagaugcuuggagcaaucagaacuucaggugugacucuagcaaggcucaucuuucugcccggcuacaucagccuucaagaaucagaagaaaggccaaggugcuggacuguuacugacuuggaucccaaagcaaggagaucauuuggagcucuugggucagagaaaaugagaaaggacagagccagcggcuccaacuccuuucagccacaugccccaggcucucgcugcccuguggacaggaugaggacagagggcacaugaacagcuugccagggaugggcagcccaacagcacuuuuccucuucuagauggaccccagcauuuaagugaccuucugaucuuggaaaaacagcgucuuccuucuuuaucuauagcaacucauuggugguagccaucaagcacuucccaggaucugcuccaacagaauauugcuagguuuugcuacaugacggguugugagacuucuguuugaucacugugaaccaacccccaucucccuagcccaccccccuccccaacucccucucugugcauuuucuaagugggacauucaaaaaacucucucccaggaccucggaugaccauacucagacgugugaccuccauacugggcuaaggaaguaucagcacuagaaauugggcagucuuaauguugaaugcugcuuucugcuuaguauuuuuuugauucaaggcucagaaggaauggugcguggcuucccugucccaguuguggcaacuaaaccaaucgguguguucuugaugcgggucaacauuuccaaaaguggcuaguccucacuucuagaucucagccauucuaacucauauguucccaauuaccaagggguggccgggcacaguggcucacgccuguaaucccagcacuuugagaggcugaggugguaggaucaccugaggucaggaguucaagaccagccuguccaacauggugaaacccccaucucuacuaaaaauaccaaaaauuagccgagcguagugacgggugcccguaaucccagcuacucaggaggcugagacaggagaaucaccugaaccccagaggcagagguugcagugagcugagaucacgccauuguacuccagccugggcaacaagagcaaaacuccgucucaaaaaaaaaaaaaaauuacaaauggggcaaacagucuaguguaauggaucaaauuaagauucucugcccagccgggcacaguggcgcaugccuguaaucccagaacuuugggaggccaagacgggaugauugcuugagcucaggaguuugagaccaggcugggcaucauagcaagaccucaucucuacuaaaauucaaaaacaaaauuagccgggcaugauggugcaugccuguagucucagcuaguuggggagcuaaggugggagaauugcuugagcuugggaagucgaggcugcagucagcccugauugugccagugcacuccggccugggugacagagugagacccugucucaaaaaaaaaaagauucugugucagagcccagcccaggaguuugaggcugcaaugagccaugauuucccacugcacuccagccugagugacagagcgagacuccaucucuuuaaaaacaaacaaaaaauuaucugaaugauccugucucuaaaaagaagccacagaaauguuuaaaaacuucaucgacuuagccugagucauaacgguuaagaaagcacuuaaacagaagcagaggcuaauucagugucacaugaggaaguagcugucagaugucacauaauuacuuucguaauagcucagauuagaauggcuaccccauucucuagacaaaaucaaauuguccuauugugacucuucuaaaaaugaagaugaagagcuauuuaaugacacaccuuggauuaaaacgggaaucacaucuuaaagcuaaaaaugaaccugcaagccuucuaaaugagucacugagcaucacuagugacaagucucgggugagcguaaaugggucaugacaagaugggacagcaacaaaaucauggcuuaggaucgacaagaaguuaaaaaacagcugcaucuguuacuuaaguuuguaagacagugcccugagaccucuagagaaaagauguuuguuuacauaagagaaagaggccagacauggugucucacacguuuaaucccagcacuuugggaggcaggggcggguggaucaccugaggucaggaguucaagacuagccuggccaacauggugaaaccccgucucuacuaaaaauacaaaaauuagccgggcaugguggcaggcgccuauaaucccagcuacuggggaggcugaggcaggagaaucacuugaacccgggggacagagguuguagugagccaagaucgcaccacugcacuccagccugggucacagagugagacuccaucucaaaaaaaaaaaagagagagagagagaaagaaauagaagagaagagccaucuuggcaggguuauuuuauaucugagcaaggaguuuaaaugagacuaguuuagauugucugcugaugcagccguccauagcaguaccccuaaaaucccaccagaauacgggucccucuaacccaguggcuggaagaaccacugucuagagcaacuuuucuuggaacugucccagcuaccaagucagacaccaagguuuaugccaccagguaacacgggaaucacagguacaugucgcuccggucagauuaguuggcuuuggccccucgacccugugcaggagcuaguucucagcuugcagcuggaaguucccucuuagcuccuuagucuagaggggucuccuggcuccauuugacccuggucuuuaauaaccggucagcaucuugcuaccuucuaccaccuuuccaaaucucuggaaauccugccagggaaagccuccaguuccaacauuggcuuuccaagcaaacuggcuuugcccucucucugccauccuuguccuccagagacugcaccaccuguagcauagaaaaccaccaccacggaccugccagccauuggcgcagcaaaccagccagcuguuugcugccaaauuccuuccucucccagguccagaccaaauacaagaucagcaccacaccgugguguugucaggagccaaagcaacaggaaacaauucaaugcuguuggguucgauucugagaguagauuuuuccagacaugucuuucaggugacccucaacuaccucagguuugaaggcccuaaaugaaacugauuaccacucauagggacaaaccgaggggguucgguuacaucuuggugauaaugcaguugucucaaacuuauaacagacucuuucacauuucaguuugcagggauaggguuggguuuguuuuucuucuguuuuuaaccuuuccccuggguuuccauuaggguaguuccuugaaaugaauuucauuuuucacugagugccuaccuucccagggcagguggccacuggcuucuguuucccuccaacaauacuuuuauuaugguauuaagaccuuucuuuguauaauacauugcaucuguguuuucaauuuuucaaauaaauauuuccgccuggcaa

SEQ ID NO: 1348 - RNA, 6855 nt, Homo Sapiens
gacagaagcagagaauacauagacuuccguuaaaaccagaaugaggaaaauacuuuucucuagcaucguaggaggaagaaaacaaacacaucagauauuuucagcacuaaaagagaugguuuuccccacauauauguaaaagaaauuugcaagacuacuggauuuugaucucaugguugcagugggugaauagguggccuuuugugaucuccuacaucacccuggaagugagacuucuucgguuucuucuagagucaguuugguaucagaauggcaaagcaacuuaaccuuccagaaaauacagaugauuggacaaaagaggauguaaaucagugguuagaaagucauaagauugaccaaaaacacagggaaauuuugacugaacaagacgugaauggagcagucuugaagugguuaaaaaaagaacaucuuguugauaugggcaucacacauggaccagcuauucaaauagaagaacuauucaaagaauugcggaaaacagccauugaagauucgauucagacaucuaagaugggaaagcccaguaaaaaugcuccuaaagaccaaacugugucucaaaaggaacguagagaaacuucaaagcaaaaacaaaaggguaaagagaacccagauauggcuaauccgucugcaaugaguacaacugcuaaagguucuaagucacuaaaaguugagcucauagaagauaaaauagauuauacaaaggaaaggcaaccauccauagaccugacauguguaucauauccauuugaugaauucaguaauccauaucguuacaaguuggauuuuagucuacagccugaaacaggaccaggcaaucucauugauccgauacaugaauucaaagccuucacaaauacagcaacagccacagaagaggaugucaagaugaaauuuagcaaugagguuuuccgauuugcuucagcuuguaugaauucacguaccaauggcacuauucauuuuggagucaaagacaaaccccaugggaaaauuguuggcaucaaagucaccaaugauaccaaggaagcccucauuaaccauuucaaucugaugauaaacaaguauuuugaagaccaucaaguccaacaagcaaagaagugcauucgagagccaagauuuguggaaguuuuacugccaaauaguacucuaucugacagauuuguuauugaaguggacauuauuccacaguucucugaaugccaauaugauuauuuccagauuaaaaugcaaaauuacaacaacaaaauaugggaacaaaguaaaaaauucucacuauuugugcgagaugggaccagcucuaaggacauuacgaaaaauaaaguugauuucagagcauuuaaagcagauuuuaaaacacuggcagaguccagaaaagcagcagaagaaaaauucagagcaaaaacaaauaaaaaagaaagagagggaccaaaguugguuaaauuauugacaggaaaucaagauuuguuagauaauucauacuaugaacaguacauucuuguaacaaauaaaugccacccagaucaaacaaaacacuuagauuuccugaaggaaauuaaaugguuugcuguauuggaguuugauccugagucuaacaucaauggaguggucaaagcuuacaaagaaagccgaguagcaaaccuucacuuuccaaguguauauguagaacagaaaaccacaccaaaugagacgauuucuacucuaaaucuuuaccaucaacccagcuggauuuucugcaauggcagguuagaccuugacagugaaaaauauaaacccuuugauccaaguuccuggcaaagagaaagagcuucugaugucaggaaacugauuucauuucuuacacaugaagacauaaugccaagagggaaguuuuuggugguauuucuauuacuguccucuguggaugacccaagagauccccucauugagacuuucugugcuuucuaccaggaucucaaaggaauggaaaauauacuguguauuugugugcacccacacauauuucagggauggaaagaucuacuugaagcaagauuaauaaaacaccaagaugaaauuucaagccaauguauuucugcuuuaagccuugaagagaucaauggcacuauucuuaaacuaaaaucugugacucaaucuucaaaaaggcuuuugccaucuauugguuuaucgacuguccuucugaaaaaggaagaagauaucaugacugcucuggaaauuaucugugaaaaugaaugugaggguacacuguuagagaaggacaaaaauaaauuccuugaauucaaggcaucaaaagaggaagacuucuaucgagguggcaaagugucaugguggaacuucuacuucucuucugaaaguuauucuucaccuuuugucaaaagggauaaauaugaaagacuugaagcaaugauucaaaacugugcagauucuucuaaaccaacaaguaccaaaauuauucaucuguaucaucauccaggcugugggggaacuaccuuggcuaugcacauucucugggaacuaaggaagaaauucagaugugcugugcugaaaaacaagacaguggauuuuucugaaauuggagaacagguaaccaguuuaaucaccuauggggcaaugaaccgucaggaauacguaccuguacuacuccuuguugaugauuuugaagaacaagauaaugucuaucuucugcaguacucuauucaaacagcuauagcuaaaaaguacauucgauaugaaaaaccucuggugauuauccuaaauuguaugagaucacaaaauccugaaaaaagugcaaggaucccagacaguauugccguaauacagcaacucucucccaaagaacagagagcuuuugagcuuaaauugaaagaaaucaaagaacagcauaaaaacuuugaggauuuuuauuccuuuaugaucaugaaaaccaauuuuaauaaagaauacauagaaaaugugguccggaauauccugaaagggcagaauauuuucaccaaggaagcaaagcucuuuucuuuucuggcucuucuuaauucauaugugccugauaccaccauuucacuaucacagugugaaaaauucuuaggaauuggaaacaagaaggcuuucugggggacagaaaaauuugaagacaagaugggcaccuacucuacaauucugauaaaaacagaggucaucgaaugugggaacuacuguggaguacgcaucauucacucuuugauugcagaguucucacuggaagaauugaagaaaagcuaucaccugaauaaaagucaaauuauguuggauaugcuaacugagaauuuguucuucgauacugguaugggaaaaaguaaauuuuugcaagauaugcacacacuccuacucacaagacaccgcgaugaacaugaaggugaaacaggaaauugguuuuccccauuuauugaagcauuacauaaagaugaaggaaaugaagcaguugaagcuguauugcuugaaaguauccaucgguucaacccaaaugcauucauuugccaagcguuggcaagacauuucuacauuaaaaagaaggacuuuggcaaugcucuaaacugggcaaaacaagcaaaaaucauagaaccugacaauucuuauaucucagauacacugggucaagucuacaaaaguaaaauaagaugguggauagaggaaaacggaggaaacgggaacauuucaguugaugaucuaauugcucuuuuggauuuagcagaacaugccucaagugcauucaaagaaucucaacagcaaagugaagauagagaguaugaagugaaggaaagauuguauccgaagucaaaaaggcgguaugauacuuacaauauagcugguuaucaaggagagauagaaguugggcuuuacacaauccaaauucuccagcucauuccuuuuuuugauaauaaaaaugagcuaucuaaaagauauauggucaauuuuguaucaggaaguagugauauuccaggggauccaaacaaugaauauaaauuagcccucaaaaacuauauuccuuauuuaacuaaauugaaauuuucuuugaaaaaguccuuugauuuuuuugaugaauacuuuguccugcuaaaacccaggaacaauauuaagcaaaaugaagaggccaaaacucggagaaagguggcuggauauuuuaagaaauauguagauauauuuugucucuuagaagaaucacaaaacaacacaggucuuggaucaaaguucagugagccacuucaaguagagagaugcaggagaaaccuaguagcuuuaaaagcagacaaguuuucugggcucuuggaauaucuuaucaaaagucaagaggaugcuauaagcacuaugaaauguauagugaacgaauauacuuuucucuuagaacaaugcacugucaaaauccagucaaaagaaaagcuaaauuucaucuuggccaacauuauucucuccuguauccaaccuaccuccagauuaguaaagccaguugaaaaacuaaaagaucagcuucgagaagucuugcaaccaauaggacugacuuaucaguuuucagaaccguauuuucuagcuucccucuuauucuggccagaaaaucaacaacuagaucaacauucugaacaaaugaaagaguaugcucaagcacuaaaaaauucuuucaaggggcaauauaaacauaugcaucguacaaagcaaccaauugcauauuucuuucuuggaaaagguaaaagacuggaaagacuuguucacaaaggaaaaauugaccagugcuuuaagaagacaccagauauuaauuccuuguggcagaguggagauguguggaaggaggaaaaaguccaagaacuuuugcuucguuuacaaggucgagcugaaaacaauuguuuauauauagaauauggaaucaaugaaaaaaucacaauacccaucacucccgcuuuuuuaggucaacuuagaaguggcagaagcauagagaaggugucuuuuuaccugggauuuuccauuggaggcccacuugcuuaugacauugaaauuguuuaagagccugauauucuuccuccaagaauuugaucucaguacccauuuaauuuuuuuggacucaagaucuaugcuuuaaaccggcaagguuauagauacagccucuagcucuucagaucuguacaugcaguauuuaauuuccucuuaaacauguuaugaguucuacaaagacaauagugaaaaaggaaggagugagauauaugaaaaguagcaaauauguuccuugguuugguuaacaucauugaugacaaaauaauaaggagcuaugacuggagucaggagaaguuaguguaauaagcuggcuacacagaaccccacuacuuaccaggcauggauugaagaagauugucuacucaaauggcauuuagacauuagaaugucugggaaaauauuucucaaagacagcaaaaaccucucaaacugaggagcaacauuuauucuuacuaagcagaucaucaauguaucaugugcuuggcacucaaggaucuuccaaaacagaggaccaaccagucuucugaaggucaugcccacagaagucaucagaccuuaccaaaguagguuggagaauuagauugccuuuucaugcagugagauucaguuaagcaaaaaugaaauuugucucuauagcuaauuagcuuaucaacuccccuccaaacaaacaauuaaaaaaaaaacauacagacacucaaauuccacaagcuaaugaacaaaagggacucuugugagaagacuaaugagucccucauccagaagaugccaauguacuggcagauuaacauacaaccuauguuuugaacaaaaacaaccagcgauacguaaucaaaauguaauuuuccccuaauaaaauuauggauaugggcagucaucaauggcugccaaaaccauuaaguggaaagcugauuaaaaaacaaaaauuucuaauggauuuaucaaacugucccaaauccugauaaauauuaacaucacagaggaagaccagacauuaugggccuggaaguacuauaggagugcacacaucacccgugacauggucuugccaaauaauuaaaccugaauuugaucaggucucuggaucuuauuugcaauucaaaagaaauuuuaaaaaaauccuacuaacaccaccacaaauaugcaaucagcaauauccagaaaggggaaauucacaggacaaaaaccugguuuucuuuuuugguuucuucaaccaaaaaagaaagaaauugcaaaggaccaaaaaaauguuggggaaucuauacauuauaagggacuuaacaacuaaagggcaacauauagacuuuagauccuaauuugagcaaaaucuaaaaucaauuauuaggcaaucagaaaaauuugaacacagacuagauauuugaggauauuaagguacuauauuauugaagauuccaugguuauguuuuuuaaagaguucaugccuuuuagagauacauacuaaaguauuuguaaauaaaugacaugaucuagaaucaguaauuuuguguuugggguguggggguggugaaagggaaguagaaccgaaacaagauuaguccugaguuaacaauggcugcaagcuggauacauggaauucagcacacuuuucucccucuuacugauuaugcuuuugaaauuuucucuuguaaaacauuuagaaaacaaaaacaaaaaaaaugugauuuguuucugucuucaaaaucucauuagaauuuuuucacuggaggaagauuuucccuugcuucugcauaaaauuuuaacuccauaacuuauaagcucacucuuuauuguuacuuucuaauugacaaauaaaaauuguauauuauuuau

SEQ ID NO: 1349 - RNA, 2707 nt, Homo Sapiens
gcaauucacgauaugcagucuccgagaugaaaacaaaagugagaaacaaauacaucagaugaugcuaugcagcucugaaggaagaacauguauugccaggacuccaacauuugugcuguguuugcuguacaaggaggaaaagugggaagaaagcauggcauaaaaagggggaggagacccagcauaagaagcccagcucagcgggccagaggacccuggauccaugagaguaagcauccggccuuugcaaagcaacagauaaacuuggagaugcccaacuccagagcgacaacagaguuagccugggucugcagcuccaccucaagaaaaaagaagugggcaaggucccugacucuuuccacugcuccacugagccccccaccauccuuggugcacugugaagauuguucuugccugccuggcugccauucgggugaccucuacaaucuggccccagcagaaagaacuugcuagcagcauaucaauagcagagauggaagucuggucauauggugcccacaucuauugaaguaaacaugcugauaccagauaucccuggcucucugucuucaaggcacaugguagaacuauacuuccuagcuuucuguguggcugggugggucacaugacaaguucagacagaugaauuaugauuagaagcauuuaauuguuaauacauauucuagugcucuuucccucugucaucacaacugacaauguuucagacagugacuucuccaacaggcugguuccagagugaaaauagagcccaguagagucuguagcugaugcaauauggacauguagggugagugagaaaaugcuuuuguuggguuaagcaucugagguuugaugguuuguugcuacugcagcacaaccuuacccauccuaacaaauaugacuauuauugacuaaccugacaacagaagagucuuuccacuucugcugugaugaggaacagaguuuuuucccuguuauaucuuaauauuagauagcagcagccucuggaaauaguucuuucucuaccacuucuuacccauguggcauaaagccagcuacuaaaccucuucacuuuucagcuuucccuuuuaaaagugggaguaaauaagaccuuucucauggaguuauugaucaaaugaaauaauuaaauaacgaguauuuaaauuuuaaauuuaaaugaaaauucaaaugacauaaugccuaugaaguacuuauuuaguccauaauauccucaguaaaugguaguuagccuuacuaacacaaaggaaauggacaaagccaugccauuuuccaaaguaguuucuaggaccauauuaucucuaaaaaucccaacuuucugcuguaaauuugaacuaauccagaacaggcuaauccauugcaauggccuauucauccuucuucuuagaguuuagcuaucagucaucuuguugcugagaacaaagccagccuaguuguuuguaagcaagccucuagagagacagaaacugucuuguauuucuuugaauauccucuacugccucuaacacugugccucggcuauauuucuggaucuuuauuuaauuguuuugaaugcuucuuauguuuaauuucugccauauccauuaggaaaacaacguaauccuuccuccaacaccgaugguauaagccuccaugaccgggaaacauuugcccccaaguuuaaagaauuuaguucuguaaggcuuguugacccaucugacaggaauuccuguaccaaguggucagucagugaagaucucuuuccacugguaacuuuaucaagaaaguaagauacaagacuguauguaaaguauauuauccuaugugaaaucaagggacagaaaauaacuggaaggaaauauuccaaaauguuagcaguaguuucucccggagaaugugauguauacauuuggaugggugauauauaaaguacuuuucauagaucugggcaagagauauuuuagagggcuccacauaccacaaucacccacaaauaaauguauuaaagagcacacagaugccuuuaucacucaggauguggcacucagagcuggcccagcauagucuauaacacuuaacaucacucucaugaccacacugcucagguccuagggaagugugccucuguaucucuucccuguauccuuaaaagaaaagaugaccuaauuugaaaguugauaaaaaucagggauuaugaugauguugcuucagaauucuuggaggacguaagagaaaaauagugcuggguuaugagaagaacaaaacuuaccaaauuccucccugaagauaacauaaaugcaauagauucuuuuacaacaaagugucauuucucaauaaugccaagaauccuuuuucaugcuucucuucuuguucacauuccugguucccaugcuacucaauuaacauaauauucagaaaaguugcagauggugauuuaggaacauguuguaauauuaacauuucauauuacccuuaaauuugcaugcaugcaucauauguguaucaugguaccaauucuuuauauugguaacuagguggauauagaacauuuacaaugugaauaguguuaucucuauaaaaacaagauuuaauuaaaauguucauauaugaaaugaaauuuuggcauauauuaauuauaacuuggauuuuaccuuuuaaaguuaauagaucauuuugaauauuuuaaaagacuuuaauaaacauauaaaau

SEQ ID NO: 1350 - RNA, 1518 nt, Homo Sapiens
gccgcuccugccgugcauguuggggagccaguacaugcaggugggcuccacacggagaggggcgccgaccccgugauagggcuuuaccugguacaucgggguggcgcgugccagacaccaacggucggaaaccgccagacaccaacgcucggaauccacgccaggccacgacggagggcgacuaccucccuucugacccugcugcuggcguucggaaaaaacgcaguccggugugcucugauugguccaggcucuuugacgucacggacucgaccuuugacagagccacuaggcgaaaaggagagacgggaaguauuuuuuccgccccgcccggaaaggguggagcacaacgucgaaagcagccguugggagcccaggaggcggggcgccugugggagccguggagggaacuuucccaguccccgaggcggauccgguguugcauccuuggagcgagcugagagcucgaguacagaaccugcuaaggccaucaaaccuauugaucggaagucaguccaucagauuugcucugggccggugguaccgagucuaagcacugcggugaaggaguuaguagaaaacagucuggaugcuggugccacuaauauugaucuaaagcuuaaggacuauggaguggaucucauugaaguuucaggcaauggaugugggguagaagaagaaaacuucgaaggcuuaacucugaaacaucacacaucuaagauucaagaguuugccgaccuaccucagguugaaacuuuuggcuuucggggggaagcucugagcucacuuugugcacugagugaugucaccauuucuaccugccauguaucggcgaagguugggacucgacugguguuugaucacuaugggaaaaucauccagaaaacccccuacccccaccccagagggaugacagucagugugaagcaguuauuuucuacgcuaccugugcaccauaaagaauuucaaaggaauauuaagaagaaacgugccugcuuccccuucgccuucugccgugauugucaguuuccugaggccuccccagccaugcuuccuguacagccugcagaacugacuccuagaaguaccccaccccaccccugcuccuuggaggacaacgugaucacuguauucagcucugucaagaaugguccagguucuucuagaugaucugcacaaauggcuccucuccuccuuccugaugucugccauuagcacuggaauaaaguuccugcugaaaauccacaucuccccuggguccgguguucuggaagugagagagacaaugucacaccucaaggagacagcucucuagacaggaagguuauucacgucccaugucaagucuagcuagaguucagagcaauugagaagugcgauuuuaucuccugccuuucauucuauacccugcuucugaaccaucguguucaacugugaaacucacgcuuuggugacccugacuccaaaacuuaauacacccaaggucagccccagugaucugcuucauagcgaggacuu

SEQ ID NO: 1351 - RNA, 4321 nt, Homo Sapiens
ccgcacgcgcccggccccuagucccagcgcggggaggguacuaucgcagcuucuccgucaggccuugggccauggccucgcuacgcaaugccaacccgaggcugaagaacuacuucaaggagaacuacauuccucaggucugcgagagaaugcgagaaagugaagucaaauucggacuuguaggcgaucagggcugaagacgcugauuagagagaaaacagagggugaugguggcugcacguggggaaugggugacaucucccagggggaaugagcacaaggcccagaucggaaaccccaaacucagauuuuaagguuuggacaagaaguaccugaggaguggaggagugagaaagaagugccagagagccugaggaggaaaaucagcagacuggcauuaugaagaauguugucagaaguagggaguaggcacuagucaccuaagauaaggagcuggauucugcccaaggcacuguuaugugguauacuuguuacauguccugaggauccgcugagguauuuagagggaaugaucaugguuauaaucaaaaguggucuucagaaucuucuuugggauaugugcauuacuccaucaaugaaaccaaacauucgaagauugucugaaacuuaccuggaacaacuuuuugaauuggaugaucagcugauaagccuguuguucaagacgacccagcaaacuguauauuuucaccagguaaagaaaguuuuuaugguucaccgaggauaaucaacugcuucacagucuagaaccuaaagacuggaucuuuugagaacaucagagaaagacugugcuugccauccacacugcaacaaaacuuuggaaccuugaacuuuaaguucauaaucucacaacugagaagggucccuccacacuauuggaacuguacacccauuggaacccuuaagaugacuccggaauugaugauaaaagccuguagcuuuuauacuggacauuuaguaaagacucauuuuugcacuuggagagacauagcucguacaaaugaaaaugucguccuggcugaaaaaaugaacagagcagugacaugcuacaauuucagacuucaaaaaucuguauuucaucacuggcacucuuauauggaagaccagaaagaaaaacuuaaaaauauucuauugcggauacaacagaucaucuauugucacaagcuaaccauuauccuaacaaaauggcggaauacagcaagacauaagaguaaaaagaaagaagaugagcugauauuaaaacaugaacuucaauugaaaaaauggaaaaauagguuaauacucaaaagagcugcugcagaagaauccaauuuuccugaacgaaguucuucugaagucuuucuuguagaugagacucuaaaaugugacauuucacuguuaccugaaagagcaauauuacaggaaucuuucaaaaacaaaaugaacacaaaugaaaggaaggcugauaaccaucauuuuacucguuacuuccauuuucuucuaccucaguuuaaaagaugugauaauauguggucaaguuaaucaugccuggauguugaugacacaacuaaacucacuguggaaugcuauugauuuuuccucagugaaaaaugugauuccagauaaauauauagugucuacuuugcaaagguggcguuuaaaugugcugcguuugaauuuucgugguugucuucuccgacccaaaacuuucagaucugucaauugcaagcacuguauuacugacagauaagaacagacuuuuuaaggcaaaggccuucuaguuccacagaacagugacguagaaagcuccuuccccucuuaguugccuggguuagaggccaaauguuugugcccugaguuugaaucaaggcucucuuaccugcuuaacuguaucaaccugggucaucuucagcaucuguaaaacggaccgaggauaccuccuaauauuguugggaggauaaaauaggcucaugcgcauaagaugcuucacauggccaccccgggggaaguagucacaaauguuaggacucagcaugaugaaaaccgaagccugcaguucaccaucacaucggauuuaagaaauucaaagaauucuccuucuuuaaaagaacacagccuugagaugcacacacaagggccacuguaggaacuugcaagaguugaaugucucugacugcccaacauucacagaugaaucaaugagacacauuucugagggcugcccggggguccugugucucaaucugucuaacacaacuaucaccaacaggacgaugcgacuccugccgaggcacuuccacaacuuacagaaucuuaguuuggcuuauugcagacgguucacagacaaaggcuuacaguaccugaacuuggggaauggaugccacaagcucaucuaucuggaccucucuggcugcacccagauuucaguccaaggcuucagguacauugcaaacagcugcacuggaauuaugcaucuuaccauuaaugacaugccaacucugacggacaacuguguaaaagcuuuaguugaaaaaugcucucguauuacaucgcugguuuucacuggugcaccgcauaucuccgauuguacuuucagagcucuuucugcuuguaaacucagaaagauccgauuugaaggaaauaaaaggguuacugaugcauccuucaaauuuauagacaagaauuauccaaaucucagucacauuuauauggcugacugcaagggaauaacagacagcagccucagaucccuuucaccuuugaagcaacugacuguguugaauuuggcaaauuguguaagaauuggugauaugggacuaaagcaauuucuugaugguccugcaagcaugaggauaagagagcuaaauuuaagcaacugugugcggcuaagugaugccucuguuaugaaacuaucugagcgcugcccuaauuuaaacuacuugaguuuacgaaauugugaacauuugacugcccaaggaauuggauauauuguaaacaucuuuuccuugguaucaauagaucucucuggaacagacaucucuaaugaggguuugaaugugcuuuccagacauaaaaaauugaaggaacuuucuguaucugaauguuauagaaucacugaugauggaauucaggcauucugcaaaagcucacugaucuuggaacauuuggaugucucuuauugcucccagcugucagauaugauuaucaaagcacuggccauuuacugcauuaaccucacaucucucagcauugcuggcuguccaaagauagcaagaauggaggcaucugcaaauaaggagggacuucccaagacaccaauugcagauuacugacucagcaauggagauguuaucggcaaaaugccauuaccugcacauuuuggauaucucugguugugucuugcuuacugaccaaauccuugaggaccuucagauaggcugcaaacaacuccggauccuuaagaugcaauacugcacaaauauuuccaaguggaggaagccuuaaccucccagaacuugagucuggaaggagagugggucugagaucugauccuuugcuccccuccagucacacaaacuuaacucgaaguguaugguaaugccagcuccauaucaaugacucaguuuccagacuuuugcaauuaauaacucaaggaaggcagcucaaagaaugucaucuaaaguucagcagcaggaauacaacacuaaugacccuccacguugguuuggcuaugauagggaaggaaacccuguuacagagcuugacaacauaacaucaucuaaaggagccuuagaauuaacagugaaaaagucaacauacagcagugaagaccaagcagcgugaccuucagccucaagcaggaagaacaaaaaaucaagaacuuggcaaguuuucuccauuuguugcaaguauguuuacuagcugaaucucaauaacaauguaaacaagcaacaaaccaucuucugauucuuauuccaacuacaaauauuuccaaacacaucaguaguucuucugucuaaauaaucaugauuuaaaaaagaagccaggccaggagcgguggcucacaccuguaauccuagcacuuugguaggccaaggcggguggaccauaagucaggaguucaagaccagccuggccaacauggugaaaccccaucuuuacuaaaaauacaaaaauuagccgggugugguggugggcgccuguaaucccagcuacucaggaggcugaggcaggggacuugcuugaaccugagaggcggagguugcagugagccuagaucacgucacugcauuccagccucggcgacagagcaagacuccgucuc

SEQ ID NO: 1352 - RNA, 3395 nt, Homo Sapiens
accuggaggcagcgcgcgcgucgaagaggcagcggcuguggagcgcggcggggcggcuccgcccagggcagcccgggcugggccaaggagcgagcucucccuucuccugcucucagccucagugaucaaggcuucagugaacugcacuggagcucccagcgggggaucuuguccccugucccgacuuuugugcugcacauuggaucuggugacacucaggaaaugcuugucuccggcuguuaaggaauaauuucagaguacuauggaucaugcugaagaaaaugaaauccuugcagcaacccagagguacuauguggaaaggccuaucuuuagucauccgguccuccaggaaagacuacacacaaaggacaagguuccugauuccauugcggauaagcugaaacaggcauucacauguacuccuaaaaaaauaagaaauaucauuuauauguuccuacccauaacuaaauggcugccagcauacaaauucaaggaauauguguugggugacuuggucucaggcauaagcacaggggugcuucagcuuccucaaggcuuagccuuugcaaugcuggcagcugugccuccaauauuuggccuguacucuucauuuuacccuguuaucauguauuguuuucuuggaaccuccagacacauauccauagguccuuuugcuguuauuagccugaugauuggugguguagcuguucgauuaguaccagaugauauagucauuccaggaggaguaaaugcaaccaauggcacagaggccagagaugccuugagagugaaagucgccaugucugugaccuuacuuucaggaaucauucaguuuugccuaggugucuguagguuuggauuuguggccauauaucucacagagccucugguccguggguuuaccaccgcagcagcugugcaugucuucaccuccauguuaaaauaucuguuuggaguuaaaacaaagcgguacaguggaaucuuuuccgugguguauaguacaguugcuguguugcagaauguuaaaaaccucaacguguguucccuaggcgucgggcugaugguuuuugguuugcuguuggguggcaaggaguuuaaugagagauuuaaagagaaauugccggcgccuauuccuuuagaguucuuugcggucguaaugggaacuggcauuucagcuggguuuaacuugaaagaaucauacaauguggaugucguuggaacacuuccucuagggcugcuaccuccagccaauccggacaccagccucuuccaccuuguguacguagaugccauugccauagccaucguuggauuuucagugaccaucuccauggccaagaccuuagcaaauaaacauggcuaccagguugacggcaaucaggagcucauugcccugggacugugcaauuccauuggcucacucuuccagaccuuuucaauuucaugcuccuugucucgaagccuuguucaggagggaaccggugggaagacacagcuugcagguuguuuggccucauuaaugauucugcuggucauauuagcaacuggauuccucuuugaaucauugccccaggcugugcugucggccauugugauugucaaccugaagggaauguuuaugcaguucucagaucuccccuuuuucuggagaaccagcaaaauagagcugaccaucuggcuuaccacuuuuguguccuccuuguuccugggauuggacuaugguuugaucacugcugugaucauugcucugcugacugugauuuacagaacacagaggugagugcccagauuggaaugggugugaaugucccggcagagaugacaauguugacuuuagguguagaccaaaguuuaaguugguagaaguggagcccuuugaugauuucuaguuagcgugagagggagcuauaacacucauguagccuguugacuagaugaacaaaaugccaauuuaaaaauuccauauaauuuugccaaaugcucuucuaugucacaauuuaugcucccaucaaugguuauguuaaaagagccuaauuuccaucauuguuucugccauuccuggucuagugcuaugcugguuuauuuauccucuugugauuuguuuuggcaccaaguacugacaugaguuucaaugacaugaagcaaacucugacaccaaguuaucguaugcauuccuuccacugucauuuccuccacccugaaccacuuucccuuguuaucucuucucccuaguaggaagcugagcccacuagggaaaguauuccaagcuacaaaguccuuggaaagcuuccugaaacugauguguauauugauauagacgcauaugaggaggugaaagaaauuccuggaauaaaaauauuucaaauaaaugcaccaauuuacuaugcaaauagcgacuuguauagcaaugcauuaaaacgaaagacuggagugaacccagcagucaucaugggagcaaggagaaaggccaugcggaaguacgcuaaggaagucggaaaugcaaauauggccaacgcaacuguugucaaagcaacacaggaugcagaaguagauggagaggaugcuaccaagccugaagaagaggauggugaaguaaaauaucccccaauagugaucaaaagcacauuuccugaggaaaugcaaagauuuaugcccccaggggauaacguccacacugucauuuuggauuucacucaagucaauuuuauugauucuguuggagugaaaacucuggcagggauuguaaaagaauauggagacgucgguauauauguauacuuagcaggaugcagugcacaaguugugaaugaccucacucggaauagauuuuuugaaaauccugcccuaugggagcugcuguuccacagcauucaugaugcaguuuuaggcagccaacuuagagaggcacuugcugaacaggaagccucggcucccccuucccaggaggacuuggagcccaaugccacuccugccacuccugaggcauagaugaggaccucacccuaggaugggguuauaagccucucaugaaguucauaauuuacacguuuuaaauacuagacgcuagauuuuuuuuucuaagggugaauacuaguaguccaggcuugauuuggagggugaaugacgccuagcaagauguauuguacuuguguuuuuuuaauugaauacuucaaagauaaacuuucauacagagaugaccagaagauggagaccguaggggaaaugccguguaauccaagcaguucaggcuuuggggccagguggacaggguuugaaugccagcucuggaaucuguuaguggggugaccucagccaagucacuuaacacuucugaacuuuguuuucucuuuugugaaauaaagaaaaaaugaaucuacaaaaaaaaaaaaaaaaaa

SEQ ID NO: 1353 - RNA, 3434 nt, Homo Sapiens
uuaaaacuagagaggaucuaggaacuggagcugcugccucugucugcuaagaugugaaguccaagacugaaaguaacauagcagaaggagaaccaaaagauauguugagucuugaugcuauuuguugaaccaguccugaauccagcugugucggaaggagugagcaugguagaaagauguggcuacaaagaggaacacacaugugguucuugcccuuuaggaguuuaauucaaguaugggggagucagcgcagcuuuugaagcuggagagcaucauauuuuagaaagaucaagcaauguggaugaggacacauuaaaaagagaagaccgagaggaggggacaccacucaggcuuauaaccuccagcucacauuucagcaccaaaggaccaaagccuagaccugagaucuggcacuugcaaaaagaaagaucaccuggaagaacaaaauagaagacuccugcucccaauaggcuugggucaggaagaaggcuguuggcauaauuguggaguaggaagauggaaaacaacuccuagagaucccaacagcugaacgcgugcuugggcaguggcugcgggugaagucaugggaaggcaagucaugaagggcauuaaucaagguaaaagcaaaaggaaaaugagguucuucagggcacagugugugggaagcaacagcaugauggaaucauuaggagagaugcccaugacuccugcgcccagcaggaguuguuucugcaggggucccugcuuccaucuccuaaguugcaggcagagagggcagaagccaggaucaucaauacccaagagggagcaucgaagagugcaugcuuccucuacuaugucgugauauagauggaggccaggauuugggagcuuuggaacacaucucucccaggccugauuguuaggagaggacuuaggcaaggugugggcaaugcuggugcuucaccuuuccuuguugaccagacagacccagaagggucauuugucaaaacaaagaaaaucucuuccaggggugaggcagguguggcugccuguaugugaaugugcugcacaccuuucccaucagcaggugucugagacccuacucuccuccugacuuuguuggcccgagcaucagccugugagguccagcacccagagcccaaaucuucuggcuccuaggcuggcacacaaccuaacaacaauuccugugccuucauauuuucaucucugcaaggaggauaguagaaauagcucucaaguagggaaugaugacugcauuugagaacagggcaaaaauaaaaucugaaaauugaacaucuugucacuaggcaguuguaacacauuuugaagauuaugagcuaaucaaaauuacacagguauucugcucuggaaaugcucaacaaccggacaggauguuuuugaaugcgguaauaaaaauuaucucuaggagcaaaaguuauuuuuuccacagaugaauuucuaauccuaaauaaucauuuacaugaauucagauuuuuuugauccaggauauguucugggaguaacuccccugcuuucccuggaugugugcgagaaagcauaggcauccacuuucugaccaacaggagacccagucucaggauggagcagacaccaugcaugguagagcagagagacagauacaaccuagguccuugaugaaaugauuggccacuggaucagccacaguuaaagacugccuaccuuuggacuucugguuaucuuaggccaaaaauguccuuuuuguuuaaggcacuuugagccggguuuucuaagaccuagcagucucaaccauccaaacuaauaagcugaauuaacuagauuuccugucauguccuuccugccugauugguagcccuugacuccaauuuggccucauuuuccguaccuuacuggcugccuuuuccucuacucauaggucacuuggaaauaaaauauagauuuacuucaaaggaauuauaccgguggcacuagagauguaaaugagaucuguuagugagcagugagaaugcauggaaagaaaaaucugacacuaguguggagaaugaacuucuuggacgagcaaacagagaccggaaguagagcagugaacgacagucaacugcaccuauggagauggcuggcaaagcuggagaaguggcugaaguccuugggagugugaagaggggauggccaaggauggagcccugaggaaucucaacaaccaaaggguaggugaagggaaaucugguuucuggauuaacuacugaauagcaacugcagucaacagcugauggaaucuugcaggaagacuaagcugguguucagagaaguuuuguucaggcaucccauuuuauuucacucauacuauccaauggcuguguuugcauguggauaugaaaguaucugaauauucugauuaacauuuguaugaaggauuucugucuacuaaagagugcaacagaauagaccaucuggagagagggcuguuucauuccgauggaagguggcaacaaaguugucaucuaaaaggaggaugcugggagugguauucuguuccuggaaauaaaagucaaccuaauccuuugucuguuguggggaaagucagaugaugugaguccuuguucacacaguaagugcccagaaaaccuuggugcuuuuccucuucccuucccugaagcugaacuucugcggaaaaauccaagagaaaguguauaaguguuccuuuuucuccacagccuugccagcuucuguuguuuuuugucuuuuuauuaauggccauuuggacuggugugagaugauaucucauuaugguuuagauuugcauuuuucugaugauuagugauggcuuuucucuagggugaagguacacucgagcguggucauugaggacaagucgacgagagaucccgaguacgucuacagucagccuuacgaguggacugaucaaguugaaagcaacagaacaagcaucuauaagaauugauuauaugucccagcacuuuggaaggcugaggcaaguggaucccuugggccuaggacuucgcgagaccaguugggcaacaugaugaacuccuacuaauuuucguccuucagaacaagauggaagaaacuacggucacauaugcaaauggagaagaugaugaacacagaaaaauuaugcaaagauaaucccuaaaccuucuuucucaucaaaaguuauagcaaggugguuuaauauaucacugacggaacacgaugcuuuguuuaaugaagacucagacggaaaggaucagacaucaaccuauaaaugcaucaaccagaaggaaagaccaauuuugaaaacuguugagcauuauucuauaccucuaagcuguucuuuucugaaccaugaaucgggagaauuauugucacucauacaugaguaugaguuguaauucucaauucccaaguaaaaaucuuccugcuuuuguuau

SEQ ID NO: 1354 - RNA, 11391 nt, Homo Sapiens
gcuuaguucagugaaucagaacaaugacugcgccgccggguacccgggagcgcgucggaggacugugagcagccgccgccgggagagcugcgggcggcgcagugucaacgcugggcucgggagccuccagcgcagauccugcccagcgcccgcagcccgcgcgaagccgcugggcuccggcacugcagcgcugcucggggacugugcauuguugugagccggagaaggggcgcggggauuacaaagccugaagaccccggagccccuuuagccauguggauaccuacggagcacgagaaauacggcgugguggauuccaagugagaagcaaacauuuuuuacaguuauugccaguuuccgaggaaccguuccauauggccugucauuggaaauuggagauacaguucagauccuggagaagugugauggcugguacagaggauuugccuuaaaaaacccaaauaucaaggguauauuuccuuccagcuacguucacuugaaaaaugccuguguaaagaacaaaggacaauuugaaaugguuauucccacugaagacucuguuaucacagaaaugacaucaacauuaagagacuggggaaccauguggaaacaacucuaugugcguaaugaaggcgaucucuuccaccggcuguggcacaucaugaaugaaauccuggaccugaggcggcaggugcuggugggccaccucacccacgaccggaugaaggacgugaagcgccacauuacugcccggcuugacuggggcaaugaacaacugggacuggaccuggugccuaggaaagaguacgcaaugguggauccggaagacaucagcauuacugagcucuaccgauugauggaacaucgacaucggaagaaagacaccccggugcaggccagcagucaccaccucuuuguccagaugaagagccucauguguuccaaccugggagaggagcuggaggucaucuucucacucuuugacaguaaagagaaccggccaaucagguaccugcacguggagauaggguuucaaugucuuaauguuagaaugguggauauuugugauuggcaagcuguaagauauauaucuuguauauuuuuuacuccgucagcuucaauuuucucaccaguagaacucugaguuucuaagcugccuguucuuuggauguuucugugagggaugaugaaugcagcauucuuugaaaaauucauaagggcuauagaaucagaauaauugauauuaaauggaaguauggcauggauaucaaaucuguuauuuguuuuaauuauuuuguauugguaacauaaagaagauacagauucucuggagaaguuugcuuaucacagucagcaugcuguaucuuucagauuuucaguaaaccauucuguuauucuuauccuaucuggaucauaugguuuaaagagacaacuaaauacuuagaaaccuucccauuaaagucucagagcuuugagaugauaacuaauuuucacauauuucuuuuucuuucgcaguucucugagucuuaccuauuacaauucucuuuugguucucuuuuucaguauuuagaaaagauauaugguguauguuuugguuuuuauugagagauuuuucuugaggcugaauagaaacgggcuucccaaagccccugauaaaccggaacgacauugcucccucuuuguggauuugggcagcagugagcuaagaaaggacauuuauaucaccgugcacauuauccgaaucggucgaaugggagcaggagaaaaaaagaaugccuguaguguccaguaccgacgacccuuuggcugugcaguucuuagcaucgcugaccugcuaacaggagagacaaaggaugaccucauucugaaaguauacauguguaacacagagagugagugguaccaaauccaugagaacaucaucaaaaagcugaaugcacguuauaacuugacuggcuccaaugcagguuuagcaguuuccuuacagcuauugcacggagacauugaacaaaucagaagggaauauucaucaguauuuucucauggaguauccauaacaaggaagcugggauuuucaaauauuauuaugccuggugaaaugaggaaugauuuauauaucacuauugaaaggggagaauuugagaaaggagggaagagcguggccagaaauguggaaguuacgauguucauuguagacaguaguggccaaacccugaaggauuuuaucuccuucggcucuggggagccaccagccagugaguaccacuccuuugugcuuuaccauaacaacagucccagguggucugaacugcugaaacuucccauuccuguggauaaauuccggggugcacacauccgcuucgaguuucggcauuguuccacaaaggagaaaggagagaagaaguuguuuggguuuucuuuugucccucugaugcaagaagaugguaggacucuuccagauggcacucaugagcucaucgugcauaagugugaagaaaacacaaaucuucaggauacuacccgcuaccucaaacuucccuuuuccaagggcauuuuccuugggaauaauaaucaagccaugaaggccacaaaggaguccuuuuguauuacaucuuuucucuguuccacaaaacucacacaaaauggugauaugcuugaucuuuugaaauggagaacccacccagacaagaucacuggcugucucucuaaauuaaaagaaauugauggcucagagauaguaaaguuucugcaggauacacuggauaccuuauuuggaauuuuagaugaaaauucccaaaaauaugggucuaaaguguuugauucuuugguucacauaauaaauuugcugcaagauagcaaauuucaucauuuuaaaccuguaauggacacuuacauugagagucauuuugcuggggcacuugcauacagagaucucaucaaagugcucaaaugguacguggaccggaucacagaagcagagcggcaagagcauauccaggaggugcugaaggugauaacaugcuguugauaacagcagagucuaacaaagcuguugcaugcugaugcuuaaacuaauugguuccucuacacagacaguaaugggugaugauguauuacugacauugcacaagaauacauuuuuaaguauauaguucaaucucgaaggcuguuuucccuugccacuggugggcaaaacgaagaggaguuccgcugcugcauucaggagcuucucaugucaguccguuucuuucuuucgcaagagagcaaagggucuggagcauuaucucagucacaggcuguguuucugagcucuuucccugccguguacucagaacuguugaagcucuuugauguccgggaaguagccaacuugguccaggacacccugggcagucugccgaccauccugcauguggaugauucccugcaggccaucaaacugcagugcauuggcaaaaccguggaaagccagcuuuauaccaacccagguagggugagucucuuggaggaaauugugccucugaaaagccauuuuguauauuuuguagccauuggucagcagaugcaauuaaaaacaaaacacuaaaaggcauuuucucaaaaccauuguuuauuuggaugguaaauguauuuaguagucaaauacaaaaguauggcaauuaaaacuuuauuucuggaaagaaugaaaacuaaugauuacauuauuguuuuuuauguuuaaugggauuuaacacuccuucagagaugcuuacagguaccugauaggauccuuauuuuucucuuuuguuuuuaaaaguuuuucaucaauuuauguucugaagcuauaugaaacuuugcauuauuguuguuuuuuacuuuaccccaagagcaaguggucagugacucaaauuaauuuuguuauaauaacuguuaguaaguuccauugccucuuguuuucuucuguuuuuuuuucccgaauaaauaacagagugaguacuauucccgauacauucuucugccugucguguuacaucaccuccacauucacuugcaagaacagaaggaccugaucaugugugcacguauccuuagcaacguauuuugucuuaucaagaaaaauagcucagaaaaaucugugcuggaggaaauagaugugauaguggccagcuugcuggauauucugcugaggaccauauuggagaucaccagccgaccucagccauccagcucagcaaugcgguuccaguuccaggaugucacuagaacaggcuuucugaauagggagucuucacauggcaguacuacauugagcaccuuuucagucugugcagacacauauggaaaagugcccaugacaaguagacacacuggggaguuuguugcuugucuccugucccuauuacgacaaaugacagauagacauuaucaacagcuucuugauaguuuuaauacaaaggaagaacuaagggauuuccugcugcagauauuuacuguguuccgaauauugauacgcccggagauguuuccaaaggacuggacuguuaugcgcuugguugcuaacaauguuauuauuacaacaguucuauaccucucagaugcacuucguaagaacuucuuaaaugaaaacuuugauuauaagaucugggauuccuacuuuuaccucgcagucauuuuuauaaaccaguugugucugcaguuggagauguucacaccuuccaagaagaaaaagguguuagaaaaguauggugacaugcggguaacaauggguugugaaauuuucagcauguggcaaaaccuaggagagcacaagcuucauuuuaucccugcccugauuggccccuuccuagaagugaccuugauaccccagccagaucuucggaaugucaugauuccaauuuuucaugauaugauggacugggagcagaggcggaguggcaacuuuaaacaggcuauggaucuaccaucuguacguggaaacugggcugcaagcauuuguguuugaaucaacaaauagauagaugucuuuggcagcaguaaacgcuacccagccaggagugugaagucauguaacucuaucuagauuagucccuuagaauuccaaaggguugccugcuauuaaccguagcugauaaugucacuuucacaaaauuuaccauggcuuuuuccuuggcacaaagaaauacguuuuaacuugccuagaaauccuacuugugaaggggaggaaagagaauaauaguuggguauguuucagguggaagccaagcuaauugacaaacuggauagccugaugucagaaggcaaaggugacgaaacauaccgcgagcucuucaacaguaugugaguaauauguuuaucucaaguugauuccauucugggggauuuggugucaguacugagccucucugcaccacgguagcugagagcugcaaagacagcuuaggucucacaggagggcuuugucuuuguggagugugaaauaaaggauaauugccuaacucaaggaaaaaacgcaaaacgucauaccagcuguacaaggauuuuccuguagcaguugcauugcaguaaaauugcuuggaugaagaugcauuccacugagagaauuccacuauuuggucccuauccuagucuacuaaagaaaauugagcgggaaacauggcgggaaaguggcguuucauuaauugcuacuguaacucgucuaauggagagguuguuagauuacagggacugcaugaaaaugggagagguagauggcaaaaagauuggcugcacaguuagccuucugaacuucuauaagacugaacugaacaaggaggagauguauauacgcuacauucacaaacucuaugaucugcaucucaaagcacagaacuuuacagaagcugcauauacccuccucuuauaugacgagcuacuggaauggucugaucggccccucagggaguuccugaccuaccccaugcaaacagaauggcagcgcaaagagcaccugcaccucaccaucauccagaacuuugacagaggcaaauguugggagaauggcauuaucuugugccggaagauugcagagcaguaugagaguuauuaugacuacagaaaccugagcaagaugcggaugauggaagccucuuuguaugacaaaauuauggaccagcaacgucuugaaccagaguucuucagaguuggauuuuauggaaaaaaauuuccauuuuucuuaagaaauaaggaguuugugugucgagggcaugacuacgagaggcuggaagccuuccaacagagaaugcugaacgaguucccccaugccaucgccaugcagcacgccaaccagcccgaugagaccaucuuccaggcagaagcucaguauuugcagauauaugcugugacucccauuccagagagccaggagguccugcagagagaggguguuccggacaacaucaaaagcuucuauaaagugaaucacaucuggaaauuccgcuaugaccgaccauuucacaaaggcacaaaagauaaagagaaugaauucaagagucucuggguggagagaacgucauuauacuuggugcagaguuugccuggcaucucucgcugguuugaaguggaaaagcgugaagugguagaaaugaguccucuggaaaaugcaauugaagugcuagaaaauaagaaucagcagcugaagacucugauuagucagugucagacaagacagaugcagaauauuaauccccugacuaugugccugaauggaguuauagaugcugcaguuaaugguggcguuuccagguaucaagaggcauucuuugucaaagaauauaucuuaagucacccugaagauggggagaaaauugcacgauuaagagagcugaugcuugagcaggcacagauucuggaauuugguuuggccgugcaugagaaguuuguaccucaagauaugagaccccuucacaaaaagcugguugaccaauucuuugugaugaagucgagcuuagggauacaggaguucucugcuuguaugcaagccaguccuguccauuuuccuaauggaagcccucguguguguagaaacucagcaccugcuucugugagcccagaugguaccaggguaauuccuagacgcagcccguuaaguuacccagcugucaaccgauauucuuccuccucacuguccucacaagcuucugcugaaguaagcaauauuacagggcaaucagaaagcucugaugaagucuuuaacaugcaggcugaggcaggagaaucgcuugaaccugggaggaggagguugcagugagccgagagcaugucacugcacuccagccugggcaacaaagcgagacugugucucaaagaaaaaagaaaaaaagacaugauuugagggucuguuuuaaaauuaucuuuacuuauguacauaucagaaaguuuccaaagguauuuuuuuuauacaagaaaaauguaguuuuuagggauuuuagagccaguauaacuccugcaagcaaacauuuuauuuaaacacuacuaauauggcauuuaugauaguucaguaagacuaagcugaaauuuuccucaccacuaucuuuggaaaggagacauaacacuuauuuccaaauucaugcuuugaacauacuuguacagauaacaagaaggcauauuuuaugccuuuuagacgcacucgccuguuuuugggcccuaggcuggaagucauucuacuuauaccucaaugaaggaaugcacugcuaacugguacgaagucacaguguauagcugaaucuaacacgaaggcauuccuuuggcaggagucaaaaucucagacuuuucauuaauucaugcagacuucuuugucaaucuaaguuauuaagauuuucuauauuguuaaacggacuuuuuguugcuaauuugaaaaaaaguugaugauuuuguuucaaauacgucagugucgugggaagccuuuaaucaggguaugauaauagcucccuguguguuuccagccaaguccaucuaccucaagcuugaguucuacucacucggcuucaccuaaugugacaaguucugcuccaucgagugccagaggucagugccagaguguggggaagacugagggugcccagagaaccuucuaguccugggaacuguggccagcugccacacguucaggcucucgccuccaaacaggugcagcaccacuaccaugcugaugauccucucucuccuucucuucccagcuucuccuuuguugucugacaaacacaaacauucccgagaaaacucuugccugucaccaagagagagaccaugcagugccaucuauccaacaccuguggagccuucgcagaggaugcuguuuaaucauauuggagacggggccuugccacgcagugacccaaaucucucugcaccugaaaaagcugugaaccccaccccuagcagcuggagccuggacagugggaaggaagccaagaacaugucggauagugggaaacuuaucucucccccugucccuccaagacccacacagacugaugauaacuuuucacugaugcucccauaucuuggcagugccacccuuugugagaacccauucuagacaggcaucauuuagcuucucccccauccucaccacccccuuugcuuagaagguccuuaugcacuggaucaucuguuuggguuuguaacacagagggcaugugcagauagucaaucgucugguuuuucuuaauugaaauguuaucucucuccccauugacagcuucaccagcaagacacacgacaucaguaucccccucgccugccgggcgaucuccauugaagggcucugugcagucuuucacccccucuccaguggaguaccacucgccaggacucaucuccaacuccccugucuugucgggcagcuacagcagugggauuucuucucucagccggugcagcacgucggaaaccucaggcuuugaaaaucaggugaaugaacagucggccccccugccggugccagugccggugcccgugccgagcuacggcggggaggagccagugcgcaaggagagcaagacuccgcccccguacagcgucuacgagcggacucugcggcgccccgucccgcuaccucacagccucuccauccccgucacgucggagccgcccgcgcugccccccaagccucuggcagcgcgauccagccaccuggagaauggggcccggaggacugaccccggcccgcggcccaggccccugccccgcaaggucucucaguuauaagucacuuuucuauguaccugcgaugcauucuuugcccguuuacaaaauaagaaguaugaugagaagacauuuaguguaggcacuuuaauaacuuacucagcuccuucgaugaauggaauuaaaacuugcuuauuaaauaucauguugcacaauauuaaaaguugcugaucuaaaacgccagauguuaaaugaaguauggcugaauuucauuaaaacguuucucauuuggaagugguaaauagugauaaagacuccuuuuguaccuuuuuauguucacuuuuuuuuauauaguuuaaucuuaaaaccaauacgauauugucaaacgauacaaugugugacaauguuguaucguuuuuacugaauacuugauacuuggagaaagcuuauuaagucagugcacauccuaacacagugguccuuauuuuagaagacuucuguaaauaaggcaagguuuaucagugcagaucaucagaauuaaaguucaagcaggcgagcaagacaguauacuuaagggguugcaaagcuugggacuggaaauuguuuuguucuugaaacaaaauacuucuuuaagguugcuuuugcuguuugacugcugucuacauucguaaaauucuauuuugugaauugguagcuaaaucccuuacuacccugacaccgugguaucuacuguauuucuuuucaaggugcaauuugcuucagaguuccaaucagcuagauuaagcaagaggcuccagaagaaauguuuacuugaauuuugcgcuuccuuucuugauaguuuccuauauaaaauuugucauugaacaagagcaaaugcugaaguauuaaugaggcacaaaugacugugccccauuagcaagaauucaggaaucaauacagacaguauuaaauuaauagcuuaagugaagaaaaaaaaaacuuagugaaaauguauuagcacgauuaaauggcaaaaggacuuauaaaaggcaagggcauuaacuuucaguccugcacaaaauaaaaaauuccucacgacucuccacuuuuaccaguggaguuugucuuagcugaccugucgucuuucucuugaaggaggauugcuguagacuucucuagcuugaauauugcaacauagcaucuuaggucuagauagggaugcuaaugccaguuguagaagugugaaaaaagcaccuuguauguaguaauguauuuuauaucuuuguuuuuucuuuuacugacuguuuauaacacucaauugacaauagauaugaacuguauuuuaaaucauacuguuaaauauuuucccucuuuuguugggaagcucauuuuaguuuaaccauguuuguuuuguugguagcuuaccuggaaggcagugaccacuuuuuuauauucucuuaaugaaaccauucagcagguauaugcuguugaggcugguuauagagguuuucuauaauaaauguucaaguauuuuuguauauaacugguuaauuuuaauaagagauaccauuauguguaaaaaaaaguaaaaauaaacgcaaacaguuguugaugcaguaugauuguuauaauuaugccaaauacuuuacguauggaaaaagaauauuuguacauaugugcuuuuaacaauucugccauauugacuuuacaauuuugaaugucggaaaaauuaauauauguuaaauauuuauguuuagugaaaguguucauaauugagaaaaggaacauaugcauuuuagcuuuguaucuugcaaguuuugcagucagaaauuuuuugaacuagcuuuugcuuuugauaacacuucguguuuguaaccacauucauauauauauacauauauaugugaagcuccauauuucuguugcuuuaaagaaguaaaaccuuccauuuaaauaagaugacaugcauaagauaacaaagcuuccuugauuuccuuuuccuguguaauuuaauagauuuguugacuagugcuugggcacauuauaaaucaguguuauuugcucuuggagccauuuuuuaaaaaaaauuuuggcagugagcaguugaauuuaucuugaauuuaucauguguguguauuucugaagcagcuacauagcagaacauuuuaagagauucuguuagcccacauguucauguugguugcugcugaaugguaaauauuaaauaaaauuaccagauuaaucuuaaua

SEQ ID NO: 1355 - RNA, 3065 nt, Homo Sapiens
ucuacacuucauagcggggaaguguuuugauggucugaagcuucuaaaucuaagggugcgcaugcgcccggagagcugaagggcgcgcggugccgacagggagcuuccuuggcuggcauggcggcgagcgcgcugcgaggccugccaguggcuggcggaggcgagaguagcgagagcgaggaugauggcugggagauuggguaucucgaccggacgucucagaaauugaaaaggcuauuacccauugaagaaaagaaagaaaaauuuaagaaagcaaugaccaucggagauguuucauugguccaggagcuccuagauucuggcauuaguguagauuccaacuuucaguauggauggacuccccuuauguaugcugcuaguguugccaaugcagagcugguucggguccuuuuggacagaggugcuaaugcaagcuuugagaaggauaagcaaaguauuuugauaacugcauguucugcucauggcucagaggaacagaucuugaaguguguagaacuacuacuuucaagaaaugcugauccaaauguugcuuguaggagacuuaugaccccaaucauguaugcugcucgagauggucacacccagguuguugcucuccuuguugcucauggagcagaaguuaauacccaggaugagaaugguuacacugcuuuaacgugggcagcacgucagggucauaaaaauauaguuuugaaguugcuugaacuuggagcuaauaaaaugcuacaaaccaaagauggaaagaugccaagugagauugcaaaaagaaacaaacaucaugagaucuucaacuuacuuucuuuuacuuuaaauccauuggaaggaaaacuucaacagcuaacuaaagaagacacuauuuguaaaauauugacaacagauucugauagagaaaaagaucacauuuuuaguucauauacagcauuuggagaucuggaaguauuuuuacauggucuuggacuugaacauaugacagauuuacuaaaggaaagggauauaacguuaagacaucuuuugaccaugagggaagaugaauuuacaaagaauggaauuaccaguaaagaccagcagaaaauucuggcugcucuuaaagaacuacagguagaagagauacaauuuggagagcuaucugaagagacaaaguuggaaaucaguggugaugaguuccucaacuuucuucucaaauuaaauaaacaguguggccauuuaauaacagcuguacagaauguuauuacugaguuaccuguaaauucucaaaagguauucuacaaaaguuauuaagugaagaaaaguaugaacacugaagaacauuccagauaaguucaugauaauucaauaaauaguauugauuugcugaaauuacaucguuuguucugcaaaaucacauaagaucuaaauaagucaauuuguuuaauauuacuccuuuacauacugauuuuaaaacuuuguauucuugccuucaagaaaaagaaaaugagucagaccaaaaauuaaacugauccguguauugaauuuaccauguguucuuuuuuaaaauauaaagugacaggagacccaagugaaaauggaaauaaaacaguguguuauuuaaaaaccauaucaauaaaauauuuuuaaauaaauuuagaauaggaagaguguaaguggcugggcauaguggcucacauccguaaucccaacacuuugggaggcccacgugggagaauugcuugaggccaggaguuugagaccagccugagcagcauggugagacccugucucuacaaagaauuuuuaaaaauuagcugcgcaugauggcaugugccucuaguccuagcugaaaauuagcugggcaugauggcaugcaccugugguccuagcuauucaggaggcugaggcaggaggaucacuugagcccaagagguugaggcagcagugagccaugauugcaccacugcacuccagccugggcaacagaacaagacacuuucucaaaaaaaagaaagaaaaaguggaaguggccugcaaaagcagcuuauuucaugugauuagguuuuagcuguuugucuuagugaaaauuuuuuaaugcacuuguuuuccagugauuuuuauauaacaucaauuaauaugagaaucaucauuuuuaaaaccuucaugaacugauuuguucaucauaaauguuauuacuaauauuaaucuccauauagaaaguuauauauacauauauucaggaaaugcauuuggcaagcucauuugauuauauuuuuauaaaauuacuuauuuuuggugucaguauuuauccuaaacaaaaaaaugccuuucaauuauguaaucuaauguuuaagaauguuguauaaucuuuguggauauaaaguuguagaaaguuauuuccauuauuuaauguugaacuuuugaaaauauuaacagauaacacuggaaugggcuucuccccagaauuuuacuucaguuugugaagaauugguuaauaauguugaagauuugagugaaaaggucugcaaacuaaaagaccuaauucaaaaguugcaaaaugaacgggaaaaugauccaacucauauacaauuaagggaagaaguaucuacauggaauaguagaauuuugaagaggacagcuauuaccauaugcggauucgguuuucuucuuuucauuugcaagcuaacuuuccagaggaaauaauccaaauauuuguuuuaaguuauauauacacaucuuauugaaccauccaaaaaucauugcuuuuaacuguuugcagcacaauauaacuuuacauucuuugccaauauuccauaggaaaaauuuugacaauguggaguuuuuuuuuaaaaagugguuuguuacuuugacuuauaaauacaauuuguuauguuuauguuaauugugauuagguaguaaaguauaaguaauuuuuugguuugaucguaucuaaaucacauucaaaauuaaaguuauaucuaauaucuuugacauuuuuuaaaguguguucauuugucagugaaucguacaggauuuguaaaguguucauaaauugagcuuucuuuuguuucuuuuuu

SEQ ID NO: 1356 - RNA, 2612 nt, Homo Sapiens
gcccgaggucggcgggaccugaucgaaggcagcgccgcgucgaccaccccgggagccggacgcuugggagccccagcccggcagcggcgcccggucacugaaguugcgccccaacucccagccgccuccaagcuucucgagcuaaguuuccugaccccuccaagggagucucacagagcucgguggcccucggccuugccaacgucacuuuaacuguuuggaacucgugagcaagaaccgagaaguggagagcccagccggggaguuuucagcuuuucuguuucacuucgggcuucuucuauucaaauggcucugcgcuggccaccgaauccugaaugaggcggggcuccucugccccaacuccagcagcgggaacuugguuccccugggcagccgggggcagggggcgccaaggccguggcgauaaugaaggcugagacggccaaggccagcgggucggcgcggggcacucccgggccggaguggccaucggccggaguucaggaggucugugacaagcagggaacaaggcaacggacggcgcaacccagccccggcugacggacgcuggcgacucagacauggacaguagcugccacaacgcgacuaccaaaauguuagcgacugcuccagcucggggcaacaugaugagcacguccaaacccuuggcuuucuccauugaacgaaucauggcgcgcaccccagagcccaaggcccugccagucccccacuuccugcagggagccuuacccaagggggaacccaagcacucucugcaucucaacucgucgauccccugcaugauccccuucgugccuguggccuacgacacgagccccaaggcaggagugacgggcuccgagccgcggaaggccagucuggaggccccggcggcgcccgcggcggugcccucggcucccgcauucagcugcagcgaccugcucaacugcgcacugagucucaagggcgaccuggcccgcgacgcgcugccgcugcagcaguacaagcugguaaggccgcguguggucaaccacucuucauuccacgccaugggcgccuugugcuaccugaaccgaggugacggcccaugccacccggcagccggcgugaacauccacccgguggccuccuacuuccucaguuccccuuugcacccgcagccaaaaacguauuuagccgaaaggaauaaacugguggucccggcgguggagaaauacccuucuggaguagcuuucaaagaccugucccaggcucagcugcagcauuacaugaaagaaagcgcccagcuucugucggaaaaaaucgcguucaaaaccucggauuucagccgaggcucuccuaaugccaagcccaaaguuuucacuugcgaaguguguggaaaggucuuuaaugcgcacuauaacuuaacccgucacaugccagugcacacaggagccagacccuucguuugcaaagugugcggaaaagguuucaggcaagcaagcacccugugcaggcacaagaucauucacacgcaggaaaaaccucacaaauguaaccaguguggcaaagcauuuaauagaaguuccacuuuaaacacucauacccgaauacacgcgggcuacaaaccguuugugugugaauucuguggcaaaggguuucaucaaaaagggaauuacaaaaaccacaaguugacccacagcggggagaagcaguucaagugcaauaucugcaacaaggcuuuccaccagguuuacaaccucaccuuccacaugcacacccacaacgacaagaagccuuucaccugccccacgugcggcaaggguuucugcaggaacuuugaccucaagaagcauguccgcaagcugcacgacagcagccuggggcuggcccgcacgccagcuggcgaaccaggcacugaaccgccgcccccgcuaccgcagcagccgccgaugacgcugccuccucugcagccgccgcugccaaccccggggccccugcagcccgggcuccaccagggccaccagugaucgaggcuaaggguccucccagccucagccgugcccccacgcugaggcagcggcagacuagagcuccugguccgaguucgucugcagaccccagggcauguugggccccacacuucagggccgaccagaagccucugcauccccuggccuuucgccucuugcaugcaccugcuaaaugguuuuguguauuauauucuauauaggcacuaacaauuaugaaaaauuuggaggguuuugcuuguuuucuguuuuucuuuuucuuuuuuuuuaauuuggaaagacuuuucaucuuggguggagagaugguguuuauuuuguuuuguuuuguuuaaacaaauuucugcuauauuuauugagaucuguauuauucuacccgggaaugcugcaucauuuuaauuuuauuauuguauauauuuccauuguguugauucuccggucucaagaugucugcuggauguugaucauuuccucuuucccugaaguaacaaaacacuguguguaugucauauauacacgcauagaugugugcgcccauagggguacauuccacauucgugagcacacacccauacacauuagauaagggugguucauuauggauga

SEQ ID NO: 1357 - RNA, 2523 nt, Homo Sapiens
aaacagcgauucuucugcagugaaucacuuccagaaaugaauagccacaguuuuuuggaaugaacguugugaaaucccuccuuuauaauggcagguuuucaguuggugguuuuaucagaauuucucaagaucaaaacgaaaccuucucuuuaaaaaggaaagaaaguacuaucgauacagaaagcaaaaguauuuccagucuccuacugaacugucacggcagaccucucuguaucuauauuuagagcuguauguccauauauuugccugaaugugugaguucuuggaaguauggauucauugccaggagcuggugauuuccuaagcagaggucgcuaacuacaagaaauguuacacucggacaaguccugcgcuuggggauccucuguacgcccguucacuggugcaggucuucugaacaaaugccuccugaggauuucugugccuggaaaauaucuguuaacagacugcuuuuacaccuacguaaguagaggcuucugcuuauaagucaaccucaagggaguuuuauuuugucccuggaugauuccucaguacauuuuucuuuuucuuuuuugagguaggguuuugcucuguugcccaggcuggaguacaguggugugaucacaacucacugcggccucaaccucccaggcucaagcgauccucccaccucagccucccaaguagcuggagugugguggaggguccaggucuucugaccauucagugcaagccaaauugugcuaauuuccaauuuuucucccuuucucuuggugagcuauuuggugcuacuucuacuccucaugaccaaagcuggcuuucaugguuuacucauguacuuacugaugaaacccugagacuuggggccagugacuguucagagguccaugugaagaugcgcugaaugguauaaaggacagagcaguaaagagugcuggcugaaugccugggcuggcaaucaggcauguuggaguuugagucccagucugccacuccagcucugugaccaagaggaagugaagucauguacccuuucuaagucucuagccccucuucugaaagacgaagaugccaccaccaaccauguuagugguugugaaugccaagaaaguccaugugaagcacauagcauagugucugccaugcguuaaguguuccaaaaauggaagcuaugacuauuucacagaguacacuucccaucacuuuucaguucauuuuggccuucucccucaaaagcacuccaguguucugauccagcugauaaaacaccaaacauucacauagugcuuuaaaagugacccacuguuuuuacagacugcauuacauaugacccuaacaaccacugcaauauagaaauucgcaucuccauucuccagaucaggauaccgaagcucagaaaaauuaaaugauuugcccaggaucacauaguuaguaagcagcccagccagauccuguguuaacuuguucauccgcuuccuauaagaaaacauccauucaaggcacauggggcaacaaagaaggacuuagagcuguguggccccucgucagggcaguaccaguugcacccauaguccggccugaauacucagcuuaggacuauuguguccaaugucccaaacauuuugaagcuacaucuuaaagaaguguccugcucagaugcaguucuccuugugaaauccgcaggccccaaggaaagugacuuuaauccaguuugcucaugcaagaacagacuggcauuucacauccaggaaaacaauggauuuguacuguucagcuuuugccaugcaaggaguuccuggugugguuuauuaauuuacaucucaggcuccagcuucacuaucaaucagauuuggaagaaaaaaguuacaaagaaaggcagcuugcugagaaacagcggaagcaugacgguacagacuggguuuugaaauggagacacauucucauggcuugugggcugagagacacugagaaaggauuuuguucuugaaagaugauuguuuuaaugcuggagauggagaguuuugacaauuuuaagugcauguucuguguguaagaaagagucauuacguuuuuuuuuucuuucagauguugccaugccuuaaaauugcugaugauuaaaauagaacauccugaguuacagaaauucagcccuaguguauccuggccuaaaaauacagaacaaucaaguugauuguuggaaaugagaggcuaggcaggguuggaaacaugcuaauguuuacugagugaaaucuuuccuucucaguagaguugcccuugcagcugaaagucacugaaagacucaacaaaauaagcagaucccacuugucucacucuguucuccuaugcaugcccuggaaagagaaugaaugagcccuuuuuaauuuaucaacugguuuucuuccaucucuuuacuagugagccauggggguuuuuugccguuaacuggguagccagucucuucauggagacuuauuuucaggaaacuagccucuugcuuuaugugaaaacaaggacccaacucaa

SEQ ID NO: 1358 - RNA, 1143 nt, Homo Sapiens
ccuuucugcacuggguggcaaccaggucuuuagauuagccaacuagagaagagaaguagaauagccaauuagagaagugacaucauguugacucuaacucgcauccgcacuguguccuaugaagucaggaguacauuucuguucauuucaguccuggaguuugcagugggguuucugaccaaugccuucguuuucuuggugaauuuuugggauguagugaagaggcaggcacugagcaacagugauugugugcugcugugucucagcaucagccggcuuuuccugcauggacugcuguuccugagugcuauccagcuuacccacuuccagaaguugagugaaccacugaaccacagcuaccaagccaucaucaugcuauggaugauugcaaaccaagccaaccucuggcuugcugccugccucagccugcuuuacugcuccaagcucauccguuucucucacaccuuccugaucugcuuggcaagcugggucuccaggaagaucucccagaugcuccuggguauuauucuuugcuccugcaucugcacuguccucuguguuuggugcuuuuuuagcagaccucacuucacagucacaacugugcuauucaugaauaacaauacaaggcucaacuggcagauuaaagaucucaauuuauuuuauuccuuucucuucugcuaucuguggucugugccuccuuuccuauuguuucugguuucuucugggaugcugacugucucccugggaaggcacaugaggacaaugaaggucuauaccagaaacucucgugaccccagccuggaggcccacauuaaagcccucaagucucuugucuccuuuuucugcuucuuugugauaucauccugugcugccuucaucucugugccccuacugauucuguggcgcgacaaaauaggggugaugguuuguguugggauaauggcagcuugucccucugggcaugcagccauccugaucucaggcaaugccaaguugaggagagcugugaugaccauucugcucugggcucagagcagccugaagguaagagccgaccacaaggcagauucccggacacugugcugagaauggacaugaaaugagcucuucauuaauacgccugugagucuucauaaauaugcc

SEQ ID NO: 1359 - RNA, 347 nt, Homo Sapiens
auggguaccagucuccuaugcugggugguccuggguuuccuagggacagaucacacaggugcuggagucucccagucucccagguacaaagucacaaagaggggacaggauguaacucucaggugugauccaauuucgagucaugcaacccuuuauugguaucaacaggcccuggggcagggcccagaguuucugacuuacuucaauuaugaagcucaaccagacaaaucagggcugcccagugaucgguucucugcagagaggccugagggauccaucuccacucugacgauucagcgcacagagcagcgggacucagccauguaucgcugugccagcagcuuagc

SEQ ID NO: 1360 - RNA, 544 nt, Homo Sapiens
uucagcucugcaggacagguagagacuccaggaucauccacugagcacuggacauaaggaaggcugcauggggaggacucaggacagugacaucacaggauaccccuccuauuaggaaaaucaaggcccagaauucacucggcucuuccccaggaggaccaagcccugaaucaggugcagugcugccuggcccacugugccaugggcccugggcuccucugcugggcgcugcuuugucuccugggagcaggcucaguggacgcuggagucacccaaagucccacacaccugaucaaaacgagaggacagcaagugacucugagaugcucuucucagucugggcacaacacuguguccugguaccaacaggcccugggucaggggccccaguuuaucuuucaguauuauagggaggaagagaauggcagaggaaacuucccuccuagauucucaggucuccaguucccuaaugauagcucugagcugaaugugaaugccuuggagcuggacgacucggcccuguaucucugugccagcagcuugg

SEQ ID NO: 1361 - RNA, 933 nt, Homo Sapiens
augggggaaaaucagacaauggucacagaguuccuccuacugggauuucuccugggcccaaggauucagaugcuccucuuugggcucuucucccuguucuauaucuucacccugcuggggaacggggccauccuggggcucaucucacuggacuccagacuccacacccccauguacuucuuccucucacaccuggcugucgucgacaucgccuacacccgcaacacggugccccagaugcuggcgaaccuccugcauccagccaagcccaucuccuuugcugguugcaugacgcagaccuuucucuguuugaguuuuggacacagcgaaugucuccugcuggugcugauguccuacgaucguuacguggccaucugccacccucuccgauacuccgucaucaugaccuggagagucugcaucacccuggccgucacuuccuggacguguggcucccuccuggcucuggcccaugugguucucauccuaagacugcccuucucugggccucaugaaaucaaccacuucuucugugaaauccugucuguccucaggcuggccugugcugacaccuggcucaaccagguggucaucuuugcagccugcguguucuuccugguggggccacccagccuggugcuugucuccuacucgcacauccuggcggccauccugaggauccagucuggggagggccgcagaaaggccuucuccaccugcuccucccaccucugcguggugggacucuucuuuggcagugccaucaucauguacauggcccccaagucccgccauccugaggagcagcaaaaggucuuuuuucuauuuuacaguuuuuucaacccaacacuuaacccccugauuuacagccugaggaacggagaggucaagggugcccugaggagagcacugggcaaggaaagucauuccuaa

SEQ ID NO: 1362 - RNA, 2310 nt, Homo Sapiens
agugcuagcauagaaucuaacaagaaauggcccugcauccauucucuuuucuucuaauaacagccccagauuuccauuuuuggaccuaccuuuuccuuuuuaucaggcuaaguguucaugguggggcucuguccuuaguuccagggauaaagccugugacccaaacuuaaaccgcagaucauuuuccccaggccauggagauuguuucaaaugugggcacauggccugaaugggucauaucagaguaaaucuuagggcuucuggguuaugccaccaucacaggcucuugcuuuccucacugaacuugaaccuagacggauguaagcuggagcuguggcagccaucauugcccugugaaaaguccacuuggagcugccaaagaccaccccaggagcuucagaaugaagacaaccuggaagucagagcugacagaaauaaggugaaguuagcuugaggaaagagcuguaaggaagagugaagucagcugagucaaggacacaagcggaaaaugugcaaagaugagccagaagcauggaaaaguaccuccaagacagaggagaacugauccaagagaaaggagaugggagugggcaucacguacagccagagggcgccaccugccgguaagagcugaauagugaacuucguguuucuugggauaaaacauuguauaauacacaguacugggaagaaaaucauauacgcacuaaugugccucuacguuauaccgccgucauuccccuaauuuaucacccccuuaugaguaaauucggguuacaaaaacuuguguaacauaacauuguauauauucuuugcaauguaugcaaauacacacaaauauguaaauauauguuuauuuguuuguauacgcguaggauaguuucagauggaaacacccaaaguagcaacacugacugccucuagggggggaaaccgagcaucuagaaggugagguguguguggguguacuuuugagguguugcccaccuguauguuuugaauauucucuaaucaaaaaaaaaauuuaaauagaaucauuaaaauuuuuuaaaacugaagacuuccccuggauccuuuccaucaucuuuaacuagaaccauucuggcuuuaugacuaaaccuaucugcuuuggucauuuacuucuuuaaaacgagacaaccaugugacauccuaggauccaucgaaugaccugguucacaagagaagccagagugcagucaggacaaggcaaacagcccuuuacuggaagaauugggcaaucuaucuggugagagguaaguuuaaauagggcagugacacugcacaacaaagucccauuuuuuggacuuuauggggguugaaaacccugccugacagacucagaguccuuaaccagacugccccagcggggagaaggguaccaggaggguuuccacgagggcagaggcagcaggugucugacuaccuacuccauuugcaaggacgaauggaaagccagggcucaccacacaggugaacaguagaagacugcaugagccgauggaaaaacagacccuaagagcagcagaagaggagaaaguccaaauaacaucuucagugagauuaagacuauaguuuauggcagucucgugcaucuaucaacaauaagaacaugcuauauagagagacaauuagaagacaagaguuaccuagagauugaaaauauaauugcugaaguuaaaaaacccuuuauuggccgggcgcaguggcucacaccuguaauccuagcacuuugggaggcugaggcaggcaggucacuugagcccaggaguucaagaccagccuggacaacacagggagacccugucucuacaaaaaaauugcaaagauuagccgagcaugguggcaugcacuuguagcuugggacuacauccuagcuacgugggaggcauagaugggaggaucaccugggcccgggaagugugaggcugcagugagcugugauugcaccacuguacuccagucugggcaacagagugagauucugucucaaaaaacaaaaaaacaaacaaacaaaaaaacaaaacaaacaacaaaaaccaccuaaacuaaacuccccccaaaaacccuuuacuuagaaaaugaugaaaaagagaaaguggcauaaaauauuagugaaaaguuaacaauucaagagggccaucugagauuggacauccacuggcaggcaucucugagugagaacagaagaaagaggaaauaugaaggcaugggaagggagcugcacagaguuaaggaagacuuugguuugcagagcgaaaaggauugccuaauggaagcacaauaaguagg

SEQ ID NO: 1363 - RNA, 2966 nt, Homo Sapiens
gugcugaccaugcuggaacugcggcgacuacagagccugcgggaaccuccccuuucgcccaagaucugcucugucccccucauccuccucccagggcccuggcgucugggucaagcagcgccccacaccucgaccccucacccccuccucccgggcucuuccugcggccuccccuccacaguccgcaggcucugggacaggaccgaguccuuggcugccuguggagcuccugugccagcagcugcgccccggcugcgcuccggauacccccauccccgccaccgccgaccucccgcuccaccgacugcugcucacgcccgacggguucacgccgccccugccccgugaaggaccgcgcugcggugcggagcgagugggagcgcagggggcgcgcgggggcucggucuucucccgcccgguccgcuccuccgggcggaacccccuuugccgggcccccgggccgcagcugguuucgggaaaccgcgcagccugggcggggccgcagcccccacccgugcaucugccgucuccgcccucccgucgcuccccugcucggggucagcuaguguccgcucugcucggccgcgggcucccggaggacugcaggugaggcgaggacucacguaggagggagggacagcugggugcagguguuucuccccagaaaaacggcuggagagcgggaggagaggccuggggcuggcgcgucccguccaccuucugccgccugcacgccuggacccuggcuggagcccuacggacgcuuuccccagccccggggcacgggaagagcuggacagaggaaaguguucggggcagccgggaagagcccaccaccuaccaggcgucgggcggcccgcaggggaaucuccguggugccggccugguucagauccgacucuucaggcgggggcgaggcagaucuagggguuggcguggggcgggggaagcggugguccugggggcccggagguagcuggaacccgaggugcccucagggcgaggccugggccgucaagggaaggucuggcuggaaucuggggcugggcuggaagcagucugaagcuccuuuguacgugugcggaauugucuaacuccuguccuuucuaaccccaaggaggccaggugggugaaagagugaaacugcuuugaaaaguagguagaguacgaaugggagguguuauuagaauuguuaauaauauuugauuuaaacugugauacuuagccaggauguccauuagaauugccuaugcaggauuuauuuuagagccaggcaagcugauucuaaagugcaugugaagaaguagucuagcaaaaauggccaugacaauucugaaagaaaaaccacacgaggggaucaugaaacagcccaauuagcauuaagcuccauguuaaaauugugguaaugaugccuagcccaugagacaugccaaugggcagaauauaaggacuagaauaggccuacauuccuaggggaacuucauuucugcucaggagagaauuuuaaaucacugagaaaaagaggauguauuuuccgcaaauggaacguaucuuucagaaguuaaacaucugaaugacagcaacagaacuuggauccgugucucccaacggcgaagguuggucacccagcucccaaauuccagauggucggcauuuaaaagugaaaacugaaagcauaaaggcacuuagaagaaaauguggaagauuauuuuauaaucucgaaacggggaaguccuuuaaaagucccaccucagccucccaaagcacugggauuacaggcgugagcuauugugcccagcugggaucuugacaaagacacuauuucucuccuuucaccugugcuguguauuuuucccucgccuaguucccagaccucacugcuauaugucuucucccuggcaggcaggaugacgcaaaacacggugauugugaauggaguugcuauggccucuaggccaucccagcccacccacgucaacguccacauccaccaggagucagcuuugacacaacugcugaaagcuggagguucucugaagaaguuucuuuuucacccuggggacacugugccuuccacagccaggauugguuaugagcagcuggcucuaggggugacucagauauugcuggggguugugaguuguguucuuggagugugucucagcuuggggcccuggacugugcugagugccucaggcugugccuucugggcggggucuguggugaucgcagcaggagcuggggccauuguccaugagaagcacccgggcaaacuugcuggcuauauauccagccugcucacccuggcaggcuuugcuacagcuauggcugcuguuguccucugcgugaauagcuucaucuggcaaacugaacccuuuuuauacaucgacacugugugugaucgcucagacccugucuucccuaccacuggguacagauggaugcggcgaagucaagagaaccaauggcagaaggaggaguguagagcuuacaugcagaugcugaggaaguuguucacagcaauccgugcccuguuccuggcugucugugucuugaaggucauuguguccuugguuuccuugggaguaggucuucgaaacuuguguggccagagcucccagccccugaaugaggaaggaucagagaagaggcuacugggggagaauucagugcccccuucgcccucuagggagcagaccuccacugccauuguccugugagcugccaaagaccccacggggugcccgcaugucccugucuagggcagcccagggcccccacuccuggcuccucacacuugccuccccuauggccgcucuccagacccuccuccuuucuucuccccacauccgcaccugcuguucccacucugggguucucaaguccaugaacagauauuguugcauuuuccacaaugcugauuaaacauaauaaacaauccagaaaagcaguuuugcccagaaaga

SEQ ID NO: 1364 - RNA, 2456 nt, Homo Sapiens
ggagccccuccguccagcagccaccccgucugggaagugaggagcgucuccgcccggcagccaccccguccgggggggagguggggggggucagccccccgcccggccagccgccccguccgggagagaugggggucucgccauguuguccaggcugguguugaacuccugaguucaagugauccuccugcuuuggcuccccaaagugcugggauuacagggagcuucacaaaucauacauuaaccagagcuccugaaacagaaggccagacgggacauauuacagcaggaacuggcucaccaccauccagggucccgcaucccaggaggcuguuuaaaucaacacacagacuaugcaggugucuuucccccagcgaacuucccagcuccucggugggagggucuaaccugcccucuccccagugcgauauuucaugucaccuucugggaacugccuggcuguggcucgacgcacggugauggggaccucaccacuguccugcccaugugucagaggaggagcagaggcacagagagacacccagagaagauagccaugcaacagcagaggggaggcuggagccaaggacccccgggauugccggccacaccagaacugggccaggugcagggcgauccucccugcagacuucagagggggugcccgcagugcagagaccacagggguccccgcgccgccggaugcccgaggaugugagacugugcaccaucugcccgcugcccgcugccacguccgugugcucggggcagggaagagcucaagccagugaccuugaaagagggaacacagcugagaaacgugucagaugcccuuccgggcuggcggcgcuggcugcacaucugucuggagugcguggaugccagaagucacuguccauggggugacagcgcagccuggagcugaugagaggcugggugcgcgcugcacgucuccagcagguccccacagcaggcucugcugcaggcaucugggcggaacugagacuggacagaccgaggcugccagcagagggaggggcaggaggccugucccagggaggcacagagggggugcggcagggccucccccagccucucccucgccuggcacccccaccuucccuccuuuccucgugaucgccuucccuucccuuuccuuucuucuucccuucagaaggaggagcugugggcagagggacuuuggaaagcauggcguuacuuaccuuucacaccucucagggcuuacgccauccuccugcgaaugaugaaagacaucaucccugccuccagcugggccucggaagagagcacugauuuacagaacgggagcuuuccccuuagcguggcccccaggucagaguuucccagacggagggccuuggaagauuggcuucucucgguguuucuggcagaccaggcagaaagugaggggcagcucguguuggaaagaguucgggacacgccgccacccgugaccucuccuagaggugacggcauaugugugagcagagggaaggcuccgagcagccccggaggaaguacacaugcguggcuuuaucuaaccagacauuucccuuggaguccuuucccccacggaggguggacugacaccucagaacccuguguucuggagacccuggggggauccucccuggcagcccugcggggaaacagucucugggugcagagcagcggugccugugcuuuuuguguuuaugagucacucaucgagcagucuuugcccaaugaaagguuugaggagcuguuacuugggccaaguccuggggaagugaugaaauagagacgguuugucuucagugcuggcaaccuccccuuuuuagucacuucuuuccugucuccagagaggguuuccucucuggucauccacuugcucaggcaucaguguucugauucugcccaaacuuuccucucuuuuaaauuauccuucauggcuaggaugggaguacuuguuuauacuaauguguaaaugacuaaccagcuaauauugcuuauauucugugugggcaggaggcuuugcauaggccucucacaugucccgagguuugccuuuaggcagaggaccgucuccucugacagcguuaacuuaaugcaccugcuacgcuuaaugaauacuuaggcuugaugaauacgcagaugcgccagaucaguucuggguaaaggacaaacaccgugagcaggacagguggggucuggagggggaggcagaugcaccaaggcaaggggaaauaccuaaagacuguuagugucagcacagcgucgcuucaggccgaguaagcaaugcccauccagaaaguggcagaugguggcguguggagcaagacauggagagagaagaugaaagaugcucagaucggggcucggcaaacuuucucuacaaaggccagaugacaaauaaaggaacgguggcugugugggccacccagggccugccugaa

SEQ ID NO: 1365 - RNA, 81 nt, Homo Sapiens
gaaacugcugaagcugccaugucuaagaagaaaacuuuggagaaaaauuuucuucuuagacauggcaacgucaacaguuuc

SEQ ID NO: 1366 - RNA, 384 nt, Homo Sapiens
gaccagggaccaggaccuuuauaagguggaaggcuugauguccuccccagacucagcuccuggugaagcucccagccaucagccaugagggucuuguaucuccucuucucguuccucuucauauuccugaugccucuuccagguguuuuuggugguauaggcgauccuguuaccugccuuaagaguggagccauaugucauccagucuuuugcccuagaagguauaaacaaauuggcaccuguggucucccuggaacaaaaugcugcaaaaagccaugaggaggccaagaagcugcuguggcugaugcggauucagaaagggcucccucaucagagacgugcgacauguaaaccaaauuaaacuaugguguccaaagauacgca

SEQ ID NO: 1367 - RNA, 1426 nt, Homo Sapiens
agggcgcaugcgcggucugccucccgcggcgggccgggucuccagggaggaccugaguuuucuucacccauugucagggaggcgccaucgcccuggcuuuggggcuggggccuccggggagguuccgguaggggcguuggagaggccgcucuuuuugcaaggcccgagacggcgggccuugcgcaggccgcccuauuccgcgcccucagggcgucaguaucagccugaggcuggauacccccgcugggcccagaugcccccgcugggcccggagcauccuccggcgcugcccucccagagccacgcagaggcugagguggcgcgggggcggcccuggcuccgcgagaagcggcggcagcgagggcuggaggacccgggcugcggggcuccggggcgucuggccugggugggacugagcccauccagggacugggacuccgggguucugguguagguggauccggggcaggcucaggaccaagucccucuccuuccaccaaggagcgcccagaggccggcgggagcuccagguucaccuccuccuccuccaguguugucagauuucugaagagcauuccggaggacagaaaucccacuuccaacuggaugucuggaugaacuacugaaagcugcugaguguccugcagcaggugagcuguggccagagcccaaggaugaagggggcucccucacucugugacugugaagaggaacccugagguguagcaggcccaggccccagaaguauggaaaaaaugagguagggagggaggggaccucaggagaagacugaggucuacagaaucccagggucaaggggauggugcgguguccuggcacuauccuugauguuccaagaggggugagaauccaucuccugaguaaaagcuucacauggggugaggaggggagaauugaacagagaggaagcagggaaggccaagacagcgaccagccuuacaggccauuuccaauccagcggaagaccuucuagaagagaugauggugggagagugcugacauacuaugugaagcuacuauuuggaguuggacacgagugcauguguccuugugccacaacgggaaucuugacuacaacacaaaugaauccacucaaauguuggcaaguggagcagagucccagaacagucugcaaucucuacagguacagaaacacccccaguucaaggaucuucacaccuggauuuaggccuacuccugcaacuaccccaggcaccaauuugaucuucuacuacuuugcagacaucucuucugcaaacaccagacaaauugagacaaugaccuuccacaggacccaaaucaccucuuacugcaggaaagaagauccagugagaaaauuaguccacaaauggaauguaaauccauaaacacucuuaaguaacagaauaaauuuaguaugaacguu

SEQ ID NO: 1368 - RNA, 3320 nt, Homo Sapiens
gucugggggccgcgcccagcugggucgggacgcgcucccugagcugcccgagcuccgcggggacucgggccgggauccucgggcggcugcauuggccggggccggggccgggagcgggccaugaugggccggcggcgcgccuucgccguggacggccggggccgggcacccucucucaguuucuugcccagccccgcgcaccccgcgggcggagcccgcgccgcugcgccucccucgccgccucccuggaggggcggucaucaggggacgccaugcaggcuggaaccccuuugggcccaggcguuaaaccagccaccgccuccgccccacuuccuccggcuccgcuucccucgccuucccgcuccuucugaggaugugggaauccgcccgcgccccagcccccuccguggcugcggaccccucucccacccagugaccuccuggcccacuuccuugcccagaggggccuggguuggcauucggcucccgcgugccccgcagcucguccccgccccccuagccuguuucccguaccguucauuccgccaggacgccccgucgccagagggccuggcggaggugacagugagggggugcuaaugcugccccuucgucccuuucuuucacuucaguucuuucauuuuaaacuuuucauaaaaucuucacuauugcucacuuacaacaaaagcccaaaucgguuauagcggugauuuuuaucacucucccggugagcugcaggagagacuucaccuggcauccugaugccgcaggggcccccagagagcagauggggcuggcgagggccuggcacggggcugcauagugccuggagucaccagcaccuacagacggauccccgacgcugcccacgggugcucauccugggagagaggugacaaguucagaggugucggcagggaggcacucuuucucaaacuggccucccgggacucaggaguggagauggcaguuggggacagcccccuggccgccuuaccgggccuuucucaggacucccuggacuuugaauccucagggaguucugagccccccgcccagguaggccgacuccuggccagccagaagcugggggagguguuggagcggucccgccggcucccaacagcucccaccagcuugucaggacaacaccgcucccugcggcuggcaagcaagccugagcgugaagugccccuuggagcagggcaacaggaguccauggaggcagacacagaccuagaggcaggccuggaagaagaggcggugguggggggccuggggccuggagccugggccugccuccccgggcagggucuucgcuaucuggaacaccugugccuggugcuggagcagauggcaaggcuccagcagcucuaccugcagcugcggauccagaggcccccaggggaucccggcgaggaggagucgacccgagccccuuuaccguccccguuacacaccccaggcaaucgggggcaggggccaugggagcugcuaagccagacagagcacacaggugaggggccaucgugucucccuuuguccugccugccuggggucccaccagcagguccucugagccgaagcuugauggggugucuucuggcccuggccaaccugacugucuuucugaaggagcaaaggcugcuucacccccaaagguggaggugcccagugccaacccucccaggcugccagaaaccccaguggagccaacguaccacuugccauccucccagggacacaagguaggggacagguauauguggggcagguggugggcugggguggggggaggggaggugggggaugcaugggcacccugggggccagcaacucuggggaaaugacaggauugauuccuguuuggagcaggcgacuuguccuggcuguggcgacagcugucucugggagcuuggucgggggucugaguguggggagggcucugggugaccccucauccucugcucagcgggauaucucccacugggacaaggucaagguccugcucaaccggaucugccggagaagccaccaccacccugagcccccugccccuccugauggcucugaccccaggugagccccgugcccagcccagguuagggcacggagaggagacugauaagccaggaugcugagauugucaugccaguugucauuauuguccccgcaaaacuugagaggcagucugggaggggcugcuagaagaaacaguaguuaaaacaccccauuuacagauaaggaggcaggguucugggugggguuggggguaguugcuuuuccaaagccgcacggugagucagugacagcuaggaccagaaugugggaaaucugccuacccuagcucagcaaccccucaccgaucgaguccagggaccucccugaaaggccucagugccgcccccaccggaagaccuuuaugccaucauuagugguuaagaagcaacgagcaaaaaaccuuucuguaggcugagaccucucggugcaccuggugacccuggguggaggggacuugcugugaagucuuccucgcccucugcccucuugcugcuucuccacauugccaggaaaagcugcugacgccugcccuccucucuugagucgagggcugaaucuuucuccucuaagcagucuggucaggaaccuugguuucuugagaggcccccaagaugccgcagcuccagggcucuuccuccucaccagaaaucccugggcuuccacaaugugaacucacucauugucagguguccguggaguguuuuuggcauggugaccugucugggcccagcauguugcagauguguauuuaugcgcaaugguaugcauaucucugugugacugucaguguugcaagcuggcuggauccaaccaucucuucugaaauaaugcauccaaaggguugauauucugggggaggucacugcagaaggauggaacugaccuuuauuccccagugggcaguuacugagcuuuccuccucagagccaugcuggcagcccugggacagagaacgguguggcuuuggcugccucugcauggaaucuugccccggacuccugaagacugcacaaggaaugaggaagaucagggacaaccugggaacugaauaacuuucaaagccagugcucagcuucucugcuccguacuagcguuuacaggucuuaauucaaaccagaugccuguacuaguuuuuagaccccaagucaaccuuucugagccacagcuucccgcugggaauaaugaugccugcccuaucuaccucacagacuuguuaugaggauaaagugagauuaaacugccucaaagugcuuuguaaa

SEQ ID NO: 1369 - RNA, 112 nt, Homo Sapiens
gacugguccgaagguagugaguuaugucaauugauuguccacagucaguuacagaucagacuccuuauucuacucuaucccccuucucacuaaugcacucgacaggucuuga

SEQ ID NO: 1370 - RNA, 111 nt, Homo Sapiens
auggccaugccacccugaacaugcccaaucucgucugaucccagaagcuaagcagggucgggucucguuaguauuggcaugggagaaagagaaaagggguacaaauucauu

SEQ ID NO: 1371 - RNA, 118 nt, Homo Sapiens
gccuauguccauaccaccuugacuguagccagucucuucugaucucagaaacuaagccaggucaggccugguuaguacuuggauaggagaauccuaggacuacugagugcuggagucu

SEQ ID NO: 1372 - RNA, 252 nt, Homo Sapiens
agucauuaguggauugaauacaaauauuuauaguauaaauuaucuacaguauaaucaucuuucaugcagccuguacuaacuuugacaaauuuagguuguuacucaggcugaaccuuuggcucccagaggagaugcagcuucacucucaaggcauagacuuugcauccuccugagcaccaccagauaucucuacugaaguccacagaacaagacuauuggacuacauguucuguauguucucuaacaaauauu

SEQ ID NO: 1373 - RNA, 678 nt, Homo Sapiens
gucccugccagucugggucaaguuucuggcaccugacuuguuugccaggaaaaagacaacugcgggugaaggagaaaacccuuuccugcaugcucggcugccuucggauccaacgcuccuagcugggagaugggaagcugugggcugcgcagugggucuuuauggucuuggaaaggggacaccccaccuugugcucaucuuuguagaaucugggcaaguuuggggguccucauaaagauuuugaaauuuuugaagucuauucucugccuguuuuucuaaaaaauucuucaguaggugaauaauuuacuuaacauuguguacuugggagaauaugaugauggggacagagcaugcugcauugcauggcuucuuaggaagaaaacacuaugggcugcccugcagaaaugcaggcagaagcugucaucagugaauguugggaggauccauaauguuggauuggaauagaacuagagugagguacuguuucaugaggccuucucccaucuagaaucuuucucaggaguauucuggaugcuuugaccuggaucaguuacugcuuugguuuguggcaacaugaaaacuggcacaacaggacaaaaaugaguugauuauuucagcugaacuuccugggaguuucauucacaauaaaggagaggcagaacaaguagaaaacuggaa

SEQ ID NO: 1374 - RNA, 563 nt, Homo Sapiens
agaggaagcgguccuggcagaaacuucacauugaagcaacucugggaaauuuuucaugacgcugaaaacacaaaggauaaaauguugggagcugauccagucuuagaaaggagaacaauucaucacgucagagaaaagaugcucucuccaugucguaaguuacacaagaaguauucacgauagacaagauauggaaucaaucuguaaccaucaacaaaugaauaaagacgcugugauguauacacaaaauggaauacucuacagcaguccauugugaaagagaaggaauuccugucauuuaucacaacaugggugaaucuauaggacacgaaaaaaggcugggcgugguggaucacuucuguaauccuagcacuuugggaggcugagaagcucugaggagugaauccacaauacaguucaaagagagauuuaaauugcuaauuucccggcacuggaauguggggaaagauugucacagauuuagcaugaaagccauguauuuaacauuccuauguaauaacccucucuuaaauugcauuuugguuugagaaacagcaagaaca

SEQ ID NO: 1375 - RNA, 2778 nt, Homo Sapiens
ucauuucaacagcucucuucaucuucaggacuaagucagccccuuacacaaaggacucaugagggacaugcagucugugugcccagccugagcccaagggucuauucugauccuuuuuuuuuuuuuaagauaaagguuuuugcagguauaauaggggucuccaacaaaaaguaaagaauaauuuuguagaaagauuuugagacuuuccuaacucuccgaaacuacacaagcugguccuuuugacuuggaagcuaaauuucuaagauggaaagucacauguaugagugggaggcaugaaaccaauuauucgaccugucuggggucaugagugcagaggcggcuccuacgaaccaucugccucuucaaguguggaugagagaaaagagaaaagagggagagaggccguccaagcuuucacaacucacucucuuguguuugaaaauaucugauuucauuauuuucuauaauuaauuucuagaacaucuauucugaggaaaaugcuagaaagaaauaugcuauucauuuguaucagcauuacucuuuguugauauuaaauggcucagucacuuuaugggggaaauaaagagguugauucauggugaugugacccucucgacacuucugguucccuuuuuccugcuauauaucaagaccuacagcccuugggaagugcauuucugcauucgaagaagaaucugagagaaaccugcugcuuucacagaggaaggcauuugcuggcuuucccaaggcaagaacaaugaaaacaaagucaugaggaguucucucuaccucaaaugaaggccgcagcuccugcucaagcuauuuuggcagucugagagaacaguacauucugaaccacauugacgcagggagcauggguaucuggaccucaggcacugauaucuuccuaagucuuugggagauuuacgugucuccaagaagccccggauggauggacuuuauccagcauuugggaguuugcuguuugguugcucuuauuucagugggccuccugucuguggccgccugcugguuucugccaucaaucauagcggccgcugccuccuggauuaucacguguguucugcuguguugcuccaagcaugcacgauguuuuauucuucuugucuuucucucuuguggccugcgugaaggcaggaaugcuuugauugcagcuggcacagggaucgucaucuugggacacguagaaaauauuuuucacaacuuuaaaggucuccuagaugguaugacuugcaaccuaagggcaaagagcuuuuccauacauuuuccacuuuugaaaaaauauauugaggcaauucaguggauuuauggccuugccacuccacuaaguguauuugaugaccuuguuucuuggaaccagacccuggcagucucucuuuucagucccagccauguccuggaggcacagcuaaaugacagcaaaggggaaguccugagcgucuuguaccagauggcaacaaccacagagguguuguccucccugggucagaagcuacuugccuuugcagggcuuucgcucguccugcuuggcacuggccucuucaugaagcgauuuuugggcccuugugguuggaaguaugaaaacaucuacaucaccagacaauuuguucaguuugaugaaagggagagacaucaacagaggcccugugugcucccgcugaauaaggaggaaaggaggaaguaugucaucaucccgacuuucuggccgacuccuaaagaaaggaaaaaccuggggcuguuuuuccuccccauacuuauccaucucugcaucugggugcuguuugcagcuguagauuaucugcuguaucggcucauuuucucagugagcaagcaguuucaaagcuugccaggguuugagguucacuugaaacugcacggagagaaacaaggaacucaagauauuauccaugauucuuccuuuaauauaucuguguuugaacccaacuguaucccaaaaccaaaauuccuucuaucugagaccuggguuccucucaguguuauucuuuugauauuagugaugcugggacuguuguccucuauccuuaugcaacuuaaaauccuggugucagcaucuuucuaccccagcguggagaggaagcgcauccaauaucugcaugcaaagcugcuuaaaaaaagaucaaagcagccgcugggagaagucaaaagacggcugagucucuaucuuacaaagauucauuucuggcuuccaguccugaaaaugauuaggaagaagcaaauggacauggcaagugcagacaagucaugagagaccccgacuacuccucagccacaucgcaccaacaauucucuucaggucuaggauggcagucacuauucaugccggauaauagagaacuaugugacgcaguccucucaggagucugaguuuacagagccaacuugcagcaccugguuaugccuccuuucaucucaaagccaaagagcugccagguaaaugguuauguggucuauguuccaaacaaaccacaugaucuugccugugucacaauguaacaagacucuagcuggguccccuggugaugaguuucagcauagaauaauguucaaggaaaagaaaacgaaaacaguuuaaaucucuaccacagccucacaagcaaaugcuaaggggaacauacauguaaaaagccagcaaacuaucuucaaacucuuccguccuuaaugucuuccauggcuauugcccccacaauggucucuuuucucccugcucccuuauuaaagaacucuuucugaaaccca

SEQ ID NO: 1376 - RNA, 445 nt, Homo Sapiens
cacacucacaaaaauauacaaaugaaugaaaaugguuaugacccacccaugacugcaguggguucacugucaucugaugugaucuauaccaccuguuccuaugugacugagaggaccacuggccauccauagccugggagguuacaucaucacuuugcaccucacacucuagaaccagauaaggaagaacagugucacaugagggaaaacuuccuagcaguuggagaugcccaacaaugagugaucacauuguuuuaaaagugagacucccauugcugaucacccuggagauuucugcaugggggcacccugaacuugaaaaucucugaagugccucgcaagauucagggcacuaagguccaaaggagugaagauuggcaaacugauaauaacuccccaaaucuauuacacugacauguaucaucaaauuaauaaauuccauaaa

SEQ ID NO: 1377 - RNA, 1192 nt, Homo Sapiens
caccugcacccaggugaaauaaacagccauguagcucacacaacgccuguuugguggucucuucacacggacgcacaugaaauuuggugcccugacucggaucgggggaccucccuugggagaucaauccccuguccuccuguucuuugcucccugagaaagauccaccuaugacuucagguccucagacugaccagcccaaggaacaucucaccaauuuuaaaucagcggccaggcguuccuccagaaccuccucccacaggaacuugcuacacgugcuggaaaucuggcaacuggaccaaggaaugcccgcagcccgggauuccuaagccgcaucccaucugugugggaccccacggaaaaucggacuguucaacucaccuggcagccacucccagagccccuggaacucuggcccaaggcucucugacuccuucccagaucuucucggccuagcgguugaagacugacacugcccaaucaccucggaagcccccuagaccaucacggacgccgagcuucagguaacucucacaguggaagauacgcgcaugaaaggaagauuaagaaaaacaaaaaaauguaaauuuacuggacacugaauauauacuaaguacugcuuaagugauuuacaugucaagauuaaaauauuuugcuuuacuuuaauuaucaucauauucuucauccaucuuucauuucaucuucaucaugccauuucuuucuccuuccccugggccugaaauuuuaucaagaagacacacuugcugugugacuugauuaauuuacuuaagcaugguaagccuuuguauaauauggaagaaacgacgaggcugaauccuguuggagugauuuguucuucggacuuuguaucuuaaaugaaaucuucucccuuagaggccacauaaacugaugguacaaucugcaacucuaagcaaauucauagguuauacuuuuucuucuucauacuugacauuugaaccuagcaaguuugaauagccuguaauuugaaaacucccuugcacaucuagcagaucaagguagcuuguucugccuucuggacaaauggugcccuuaagucagcuuagggagacuguuccgauaucaagauucuguuugaauacuauauacucucagcugcuuauuuauucauauauauaugacacguuuaucauggaaguauuucaaaacuauc

SEQ ID NO: 1378 - RNA, 59 nt, Homo Sapiens
caguguucauguagauguuuaagcucuugcaguagguuuuugcaagcuagugaacgcug

SEQ ID NO: 1379 - RNA, 584 nt, Homo Sapiens
agagaggugggaaggugauacaaacaggugguccgcugguaauccccaucgagugacuggaugaucugcaaaagaggaaaacaacccggccagagagucaggggacggccaccagauggcccuguggaccgccgcccgacccccgagcaagccgugugccccgagggcccgacccaagaucacacagcucucugccacucacucuggaggagaccagaaaccucgaggugcugucuucacucggcuccucucucacacagcccugauggagaaggugggucccuggcacgugggccccaggagggagaagacuccgcuguacaggagguucuggaaggaagccgugcgccuggcucuuacgucccagcucuucccuacaucuucuuucacgcugcagcggaaaccagaaugccuacuaauuccuuaagaaccaaagguucaaguggugcuaccuauguauuugcuucuuacguccccugaacgucgcuacgauuccacacgacagcccucgagaauucuuucaaguuuuccaaauguccucuaccguagaaacaucucaauuaaaacaagaguuuccaaacugu

SEQ ID NO: 1380 - RNA, 463 nt, Homo Sapiens
aggaguuuaggagagagaggugacuccaaggugacaucccgagaaaccuggcaagcaguuggaaguucaacacaguuggagaacgagcuacucagaaaaggaucuaccgugcaugaagaaacagauuaacauaauucaaauuaugagcagcuauauuuguagcucugcuaagggaauguagacaugucuacauaugaauacagcccucaccuguauagacacuaaaauguaauucagguauuucauuucauucucucaucuccucacuucaauuuuaggugagaauaccaauucaauucuccauacaucaaauuuccuucuccugaaaaauauuauaggauuuguggacagaauuacuuuuauguaaagucuucaugauaacugaauuggacuacguuguguuugcacccauauaaaucuaaacaagccugagagcagcuuuaucucuaacuuucugucugac

SEQ ID NO: 1381 - RNA, 3281 nt, Homo Sapiens
gcggugcgggccgggcgggugcauucaggccaaggcggggccgccgggaugcucaggguuccggagccgcggcccggggaggcgaaagcggagggggccgcgccgccgaccccguccaagccgcucacguccuuccucauccaggacauccugcgggacggcgcgcagcggcaaggcggccgcacgagcagccagagacagcgcgacccggagccggagccagagccagagccagagggaggacgcagccgcgccggggcgcagaacgaccagcugagcaccgggccccgcgccgcgccggaggaggccgagacgcuggcagagaccgagccagaaaggcacuuggggucuuaucuguuggacucugaaaacacuucaggcgcccuuccaaggcuuccccaaaccccuaagcagccgcagaagcgcucccgagcugccuucucccacacucaggugaucgaguuggagaggaaguucagccaucagaaguaccugucggccccugaacgggcccaccuggccaagaaccucaagcucacggagacccaagugaagauaugguuccagaacagacgcuauaagacuaagcgaaagcagcucuccucggagcugggagacuuggagaagcacuccucuuugccggcccugaaagaggaggccuucucccgggccucccuggucuccguguauaacagcuauccuuacuacccauaccuguacugcgugggcagcuggagcccagcuuuuugguaaugccagcucaggugacaaccauuaugaucaaaaacugccuuccccagggugucucuaugaaaagcacaaggggccaaggucagggagcaagaggugugcacaccaaagcuauuggagauuugcguggaaaucucagauucuucacuggugagacaaugaaacaacagagacagugaaaguuuuaauaccuaagucauuccuccagugcauacuguaggucauuuuuuuugcuucuggcuaccuguuugaaggggagagagggaaaaucaagugguauuuuccagcacuuuguaugauuuuggaugaguuguacacccaaggauucuguucugcaacuccauccuccugugucacugaauaucaacucugaaagagcaaaccuaacaggagaaaggacaaccaggaugaggaugucaccaacugaauuaaacuuaaguccagaagccuccuguuggccuuggaauauggccaaggcucucucugucccuguaaaagagaggggcaaauagagagucuccaagagaacgcccucaugcucagcacauauuugcaugggagggggagaugggugggaggagaugaaaauaucagcuuuucuuauuccuuuuuauuccuuuuaaaaugguaugccaacuuaaguauuuacaggguggcccaaauagaacaagaugcacucgcugugauuuuaagacaagcuguauaaacagaacuccacugcaagagggggggccgggccaggagaaucuccgcuuguccaagacaggggccuaaggagggucuccacacugcugcuaggggcuguugcauuuuuuuauuaguagaaaguggaaaggccucuucucaacuuuuuucccuugggcuggagaauuuagaaucagaaguuuccuggaguuuucaggcuaucauauauacuguauccugaaaggcaacauaauucuuccuucccuccuuuuaaaauuuuguguuccuuuuugcagcaauuacucacuaaagggcuucauuuuaguccagauuuuuagucuggcugcaccuaacuuaugccucgcuuauuuagcccgagaucuggucuuuuuuuuuuuuuuuuuuuuuuuuuuuccgucuccccaaagcuuuaucugucuugacuuuuuaaaaaaguuugggggcagauucugaauuggcuaaaagacaugcauuuuuaaaacuagcaacucuuauuucuuuccuuuaaaaauacauagcauuaaaucccaaauccuauuuaaagaccugacagcuugagaaggucacuacugcauuuauaggaccuucuggugguucugcuguuacguuugaagucugacaauccuugagaaucuuugcaugcagaggagguaagagguauuggauuuucacagaggaagaacacagcgcagaaugaagggccaggcuuacugagcuguccaguggagggcucaugggugggacauggaaaagaaggcagccuaggcccuggggagcccaguccacugagcaagcaagggacugagugagccuuuugcaggaaaaggcuaagaaaaaggaaaaccauucuaaaacacaacaagaaacuguccaaaugcuuugggaacuguguuuauugccuauaauggguccccaaaauggguaaccuagacuucagagagaaugagcagagagcaaaggagaaaucuggcuguccuuccauuuucauucuguuaucucaggugagcugguagaggggagacauuagaaaaaaaugaaacaacaaaacaauuacuaaugagguacgcugaggccugggagucucuugacuccacuacuuaauuccguuuagugagaaaccuuucaauuuucuuuuauuagaagggccagcuuacuguugguggcaaaauugccaacauaaguuaauagaaaguuggccaauuucaccccauuuucugugguuugggcuccacauugcaauguucaaugccacgugcugcugacaccgaccggaguacuagccagcacaaaaggcaggguagccugaauugcuuucugcucuuuacauuucuuuuaaaauaagcauuuagugcucagucccuacugaguacucuuucucuccccuccucugaauuuaauucuuucaacuugcaauuugcaaggauuacacauuucacugugauguauauuguguugcaaaaaaaaaaaaaaagugucuuuguuuaaaauuacuugguuugugaauccaucuugcuuuuuccccauuggaacuagucauuaacccaucucugaacugguagaaaaacaucugaagagcuagucuaucagcaucugacaggugaauuggaugguucucagaaccauuucacccagacagccuguuucuauccuguuuaauaaauuaguuuggguucucuacaugcauaacaaacccugcuccaaucugucacauaaaagucugugacuugaaguuuagucagcacccccaccaaacuuuauuuuucuauguguuuuuugcaacauaugaguguuuugaaaauaaaguacccaugucuuuauuagauuua

SEQ ID NO: 1382 - RNA, 6622 nt, Homo Sapiens
ugugucuuggacugggacagacagccgggcuaaccgcgugagaggggcucccagaugggcacgcgaguucaggcucuucccuacuggaagcgccgagcggccgcaccucagggucucuccuggagccagcacagcuauucguggugaugaugcgccccccggcgcccccagcccggugcugcaccggcccccaccucccggcuuccagaaagcuccccuugcuuuccgcggcauucuuugggcgugagucaugcagguuugcagccagccccaaagggggugugugcgcgagcagagcgcuauaaauacggcgccucccagugcccacaacgcggcgucgccaggaggagcgcgcgggcacagggugccgcugaccgauggggaaacugagaccuggagaccugccgcguugcgggagacccaggcuagcaggugacagagcuggccugcaccgagcuccuuccugcagcauauccucugcgaagaugcggaucucucaguuguggcuuucggcuugcaugcaugagucaucuaguuuucuucuaaauucucuagcucucuggacacuguugccuguaaguaugaggcugcggauuucaguauaugcugcaaccaccgaaauccgacuuuuucugccuccuaaugcaucugaggugcaucagagaaaagucacacaagauccaccaggccucagaccucugauuccacagucucauuuuacagaugauaaucugaggccuggagagguuuaggacuggugccaacacuaaacagcaaauaaguaucagaauugggauucgagccaaagccucuugaccuuccagaauuucuggaccuaguuaaaaaaaauaugauuuuuauuauuauuuuuuaaacggagagguuaggaauuuaaaggaaaguacagauacuauauaaaaaaagaugcccaugaaaauguuaaguuauaauaauaguggagcauugggcacaacugaaauggccaaucuugugagaaugguaaaauaaacuuagguccgugaguaaguggaguauuacauagccauaaaaguaugcccuuaaagaauauuugaagauggugaaugugaagaaucuuguauaaacugcauggaagacagaaggaaauauaccacagugcuaaccuuugccucugggugauaugaauuaccgcuuucaggggccccuggcagagagguguuucuggcuggcuuugucucucuggcaugacaaaggcucuguuccugcuggaggcauuucagggcucagugggcagcuggggcagagcccgugagaccacagccuuccugucuuugcgccugauuacuucucaugagaggcacuccuuguuaaugugcuacugaguguccagaugggccugcugggcugagcgggcuuuggaugugaaccauuucaggaaggggaaccccaucguccuguugguucugugauggcaaauggggcaggaacacuggcagggcagccugcugucggcuuagaggggaugggcaguguggagggccuggcagagcaagaggacucauccuuccaaagggacuuucucugggaagccugcuccucgggccacugcgaacccucucuacucuccgaagggaauuguccuuccuggcuuccacuacuuccaccccugaaugcacaggcagcccggcccaagucucccacuagggaugcagauggauucggugugaagggcuggcugcuguugccuccggcucuugaaagucaaguucagguggugcugagacucccugggggcugcagcgcuguggugaauggggagcgucugcuggggugaagguuuaggugcacauugcagaggacguggcuggucucugggaugcagucccucuguggagguggcauggggagggacggaugcaugaccuaagggggguauuuucagugucugacaugaucgauaccacucuggacaaggaggccaggaugcagaaagccugugugccucgcugauugucggggaggauguggcuuggacaagagccugguuccuccgaugccaggguucuuguuucuuccacucaacauugcuguccugcagucccucccucccugcaccuccugccuucgcuuucauucgagguguccauggcaagucuggucauuuccccccauuuccucaggaauaaaagugcagcagugccugcuguggggacagcugagggcagugaggcccuggggagcugcugcaggcagcaggugggcgggacgccagcaggcugucuagcuguucccaugauggucuccuguucucugcagaggcgugcaaagacuccagaauuggaggcaugaugaagacucugcugcuguuuguggggcugcugcugaccugggagagugggcagguccugggggaccagacggucucagacaaugagcuccaggaaauguccaaucagggaaguaaguacgucaauaaggaaauucaaaaugcugucaacggggugaaacagauaaagacucucauagaaaaaacaaacgaagagcgcaagacacugcucagcaaccuagaagaagccaagaagaagaaagaggucaggaggagccgcuaccgccucccugccuugaccaucccacuggaggggagggagggggucacugcgcggugcccugcuggguugccauggugacccgcaguccucccaggcugugucagcugaugcugaggcugcaauuaagaagcagggaagguucauuugcuucugaaagcaucagggagugagaucuuggaucugguuuuguuaugagccuggcccagggccuaaugcccagauucauuucaauagauguuucuaagcccugaucacaugcuaguuccaagcaggcucuggaugggguggcggcaggggcccagacaggcguggcguccaaccuucaggaagcuuaucuaauaggggugauaugguuaggguuaaggcaggcacacagcacgaugcccuaaaugagaccagggaaucagagacaaagcugaaggagcucccaggagugugcaaugagaccaugauggcccucugggaagaguguaagcccugccugaaacagaccugcaugaaguucuacgcacgcgucugcagaaguggcucaggccugguuggccgccagccagcuugaggaguuccugaaccagagcucgcccuucuacuucuggaugaauggugaccgcaucgacucccugcuggagaacgaccggcagcagacgcacaugcuggaugucaugcaggaccacuucagccgcgcguccagcaucauagacgagcucuuccaggacagguucuucacccgggagccccaggauaccuaccacuaccugcccuucagccugccccaccggaggccucacuucuucuuucccaagucccgcaucguccgcagcuugaugcccuucucuccguacgagccccugaacuuccacgccauguuccagcccuuccuugagaugauacacgaggcucagcaggccauggacauccacuuccauagcccggccuuccagcacccgccaacagaauucauacgagaaggcgacgaugaccggacugugugccgggagauccgccacaacuccacgggcugccugcggaugaaggaccagugugacaagugccgggagaucuugucugugggugagucgggguccagaccacaagccguccccccugaucccuuguguccuggggucacuggggccucacuggugggcagacuguuccaccaacaaccccucccaggcuaagcugcggcgggagcucgacgaaucccuccaggucgcugagagguugaccaggaaauacaacgagcugcuaaaguccuaccaguggaagaugcucaacaccuccuccuugcuggagcagcugaacgagcaguuuaacugggugucccggcuggcaaaccucacgcaaggcgaagaccaguacuaucugcgggucaccacggugagcugugucccggccacaugcuguggcucgggagcccgagcugugaucgggagcaggggcaugugugcuuuugacugagcauuuaucacacggcagaaaauagaaaacuuuaggcgccccuguugccuugaagccucaucacccacucagggaaaauauaacccugcuuuacaaaggagcaaaguaagagagguuccacagcuuggccaaggugugauagcugacagaugacuuggacggguauuugaaccugacugccuggcugccaagccuguauuuuguuguuguuguuuuuguuuuggugcacaaaucugugaauaaaccagaagccucuguucuuuucucaaagcuacaaggcugcccucuggcauguaaaauggcuuaugaauuaguacaucacucucugccagugauaaaaacuucucucuaggccagacaugguggcucaugccuguaaucccagcacuuugggaggcagaggcaagaggauugcuugaggccaggaauuugagaccagccugggcaacacagcaagauucccucucuacaaaaaauacaaaaaucagucaggugugguggcacacacuuguagucccagcuauucaggaggcugaggugggaggauugccugagcccugaaguggaggcugcagugagcugugaucacgccacugcacuccagccugggugacagagugagacucugucucuuaaaaaauauauauauauaaaauaauaaaauaaaguuaaaaaaucaaauaaaacuuauuucuaguacugggaacucuucuuuuucuuuucuuucuucccuccaggcccucuggauuccuuuucuacccuacucugaccaagggcugcuucuaaagcaaauguuuggaaaccacuuuuauucuuuggggugcucccugggcuggucauuugcagaugacauuugccccaacacaugagugucugugaaccagguccguucuguccacugagcuguacuuacgucuagauguauaagaagcauggggucagcucucuagguuuccuuggagaagcaggaggacuuccuuaucagaagccugacuucuguugcagagcgcaugcauuuugaccacaguguuucagcucuucccuuuucucuuguuccauuuagguggcuucccacacuucugacucggacguuccuuccggugucacugagguggucgugaagcucuuugacucugaucccaucacugugacggucccuguagaagucuccaggaagaacccuaaauuuauggagaccguggcggagaaagcgcugcaggaauaccgcaaaaagcaccgggaggagugagauguggauguugcuuuugcaccuacgggggcaucugaguccagcuccccccaagaugagcugcagccccccagagagagcucugcacgucaccaaguaaccaggccccagccuccaggcccccaacuccgcccagccucuccccgcucuggauccugcacucuaacacucgacucugcugcucaugggaagaacagaauugcuccugcaugcaacuaauucaauaaaacugucuugugagcugaucgcuuggaggguccucuuuuuauguugaguugcugcuucccggcaugccuucauuuugcuauggggggcaggcaggggggauggaaaauaaguagaaacaaaaaagcaguggcuaagaugguauagggacugucauaccagugaagaauaaaagggugaagaauaaaagggauaugaugacaagguugauccacuucaagaauugcuugcuuucaggaagagagauguguuucaacaagccaacuaaaauauauugcugcaaauggaagcuuuucuguucuauuauaaaacugucgauguauucugaccaaggugcgacaaucuccuaaaggaauacacugaaaguuaaggagaagaaucaguaaguguaagguguacuugguauuauaaugcauaauugauguuuucguuaugaaaacauuuggugcccagaaguccaaauuaucaguuuuauuuguaagagcuauugcuuuugcagcgguuuuauuuguaaaagcuguugauuucgaguuguaagagcucagcaucccaggggcaucuucuugacuguggcauuuccuguccaccgccgguuuauaugaucuucauaccuuucccuggaccacaggcguuucucggcuuuuagucugaaccauagcugggcugcaguacccuacgcugccagcagguggccaugacuacccgugguaccaaucucagucuuaaagcucaggcuuuucguucauuaacauucucugauagaauucuggucaucagauguacugcaauggaacaaaacucaucuggcugcaucccagguguguagcaaaguccacauguaaauuuauagcuuagaauauucuuaagucacugucccuugucucucuuugaaguuauaaacaacaaacuuaaagcuuagcuuauguccaagguaaguauuuuagcauggcugucaaggaaauucagaguaaagucagugugauucacuuaaugauauacauuaauuagaauuauggggucagagguauuugcuuaagugaucauaauuguaaaguauaugucacauugucacauuaaugucacacuguuucaaaaguua

SEQ ID NO: 1383 - RNA, 442 nt, Homo Sapiens
aggagaaaaaugggagaaucugaugauaacagcaggcccuuugaagagccaccuugaaggaagucaaagaaguauauuucaggcucuauaggucagaagucugcagcgagucucaugaggcuaaaaucaagguguccacagcagucauuauucuacccaccagagacacagaagcuuguccuggcaagaauccuaucuguaagcucuacagaacuagcauuuccucaauuuccaucugccaagaugcuaacagagaacacaucaaguagguggaacacacaagggacugaccuugacuuaaagcaaguauggcaaucuaagaucucugccaugacaugacuauaguuuaugaaccauuuacaaugguaguaauaucacauuauucauugucuguauaccaugugccccagauauuaaagccaauugaugcauacugucuuuc

SEQ ID NO: 1384 - RNA, 255 nt, Homo Sapiens
aguuagcagcaggauucuggauggcugacaccgaugcugcugcaccuuuuggaaaaaauggauccaacugcuugccccgucaucccagauggcuaggcccccauucauccccucucgcucuccuacuggaggaacugcuguaugaaucauaaagcucuggguagggaagcagggagcagguuccaggcagagcugacaagugacuucacuuuugagcaucgguugaaccagauuuaacgucucuuccaguucuaa

SEQ ID NO: 1385 - RNA, 877 nt, Homo Sapiens
gucaccauaagcuuuugauagggcuuuugucuuucccuuucucauacauuuuucuguccuagagaaagugggagauuuaaaaauuauguauucugucuuugcuuggguacugugaagucagguauauuuguagaguuggguuagcgagguagugacaauuuccuuuuaaagauguauaucuucuuucuccccaauucuuuccaaagaaauuacugaugcugaggaagauccugaggauaaagcaacaaacaggcagucuggaaccagugacauuaaagaccugaacccugcaccucaucuugggacaauucuaagggcuaccugaguuccacauauuaucaaggacucagcugaaucuuuugauggaaaacuugagaccagcgucagagcuagacaagggccauggagggccaaggucauggcagagccucaauugucuccacagggagcgguuauggacaaccuaagagucuugcucuguugccuaggcugaagugaaguagugugaucucggcucgccacaaccucugccucccagguucaagcgauucuccugccucagccucccgaguagcuggaacuauaggucaucuaggggaaaacagaaguaugaggauugagacuucuucugaaaaucagugaguggcucucugcagugguuacagaaaugccccagcauggacucccuccuguaaacuggcucugcugucccagcagugacggaaagcacucaauuuguuuucucuuggaagagacagaguggcugucaguuuacugcaauauuuuggacugccuggaaaauucaauguacaacaggagaaaggagaggcaggagacagacucuggaauagaagucaaagacaaagaggcucguaaa

SEQ ID NO: 1386 - RNA, 1257 nt, Homo Sapiens
auaugcaagcucacuuaagacauucaaggaggucuggauccuuuccucacugcccaggcccgggcccaccccaccuuuaaccgucaggguuccccacuaccugggaagccccacacccuccaaagaugcgcuaggugcgccagacgcaugcuccucugcuccgcuggcuccgaagaaccagaucugaggccaagauaaaacccgauuccugauguccgacccccuaacauuagaagucgagagaugaagggaaaacucggaaaucagagccauggauucaaaccagcacuggaaaaugccccgggacaguucgugcugagcgccuuagccacagaguggccucgcagcuggggcaagggggacauccccggcgccgcggagccgcgagcggagcgagcgcccggggcgcaccugagccuccagcacuccccgcggccgcguggcuggccaagaaaaauuggcaucuggcauaccuaggaaucauucaaaauaguuuaauaggaaggacauuuugaggccagccagcauuaugacauuuguggguccuacggcauuucaccuuggaaacauuuuccugggcaucuaaaaguauuguggaccugagacacugugcuuacagggccuacuggguugauucuaaagaagaaagaaaaucuauaugcaugaaaagaugucuuaaaaaguuuugaacuacucaaaguuaagauuuggggaaauagaaauaguauauaacuuaagaaaauugccacuggcugugaacccccauggcauuuucuuugcacuuuuuugcuucucguuagauuguauguguuuuuaccauuucacacaaacuuuuaaagauuauuccacgccguuagcucugugcuucuauuuucacuguaugagaccgagaauggauuauggcaguuccucuuaccuccgcugcauacuugacuccauccacggugugcucagagccaugaucauccgaagagccccagugaagaugaaacuggcgaagucgguaggguccagggagaggacccccucucagcacugugauucagauaagcuuggucaacagugaauucaugcuucuuuuacagagcucuacuuuaaccaagugcucuuagagccaaggcuuaauggacaaaauguggucaguuugcuggguggauggugccacucccaggacacuggacuccucacaaaaugaagucuggggauaugucaagauaaaugauuguucuuuucugucuuucuuauuuuguuugcuug

SEQ ID NO: 1387 - RNA, 7032 nt, Homo Sapiens
auguugcgagccacagcucccugcugguuccccccuggauacccagaagcuaagaagguggccgaggaggcggcccuggaggcaagccgccauuugggaggggagcagagccaggccggugcucccgaaggcagcaagauguugcgagccacagcucccugcugguuccgcccuggauacccagaagcuaagaagguggccaaggaggcggccccggaggcaagccgccauuugggagcggagcagagcccggccggugcucccgaaggcagcaagauguugcgagccacagcucccugcugguucccaccuggauacccagaagcuaagaagguggccgaggaggcggcccucgaggcuccagaauucccacugcccucucaucagccugcccagagcuucgggcucugggugccccagaugcacaagcaggccucagcauuuguggacauccaggcggagccccaaaacagggguccggcggugcccccagcguggcccaagauggugacggagucgugcuacuucccugcgcagaggggaucggccugccgcuugccagccgccccaaggcugacagagaggcccucgggaguccgcaucucagcccccaggaagaggaagacgaucgcccacucuuccagcccuugcuuggucacagguuacacagaugccaagagaacccggguggccagcagcagccaacgcucccguggcuccaaggucggcagacagccagggaagacgcgcaacaggucagggauggcaugcaagaccaccgccaccaccagcucuaagcgaaucguccgucgugcauccuuaccgaguuugaguuugaagaaacccauuauccuccgaagcucugggugccaaguccccaccguccuccgccgaggcuaucuccaacuguucaccgaagagugucucaaguucugcgccuccaagcaggaggccgaggagaaggcgcugaacgaggagaagguggccuacgacugcagccccaacaagaacagguaccugaacgugguccugaacacccucaagagacugaagggccugacccccagcuccaugcccggccucagcagggccgcccuguacagccgccuccaggaguuccugcucacccaggaccagcucaaggagaacggcuaccccuucccgcaccccgagcggcccggaggcgccguccucuucacuggccaggggaaggggcccggcgacuccuccuguagggucugcugccguuguggcaccgaguaccugguguccuccucgggccgcuguguacgcgaccaguuguguuauuaucacugggggcggguccgcucgagccagguggcuggaggccggguuagccaguacaccugcugugcagcugcuccuggcucugugggcugccagguggcaaagcagcacgugcgggacggccgcaaggagagccucgauggcuucguggagaccuucaagaaagaguuguccagagacgcuuauccaggaaucuacgccuuggacugugagaugugcuacaccacgcauggccuagagcugacccgcgucaccgugguggacgccgacaugcgagugguguacgacaccuucgucaagcccgacaacgagaucguggacuacaacaccagguuuuccggagucaccgaggccgacgucgccaagacgagcaucacguugccccaaguccaagccauccugcugagcuuuuucagcgcccaaaccauccucaucgggcacagccuggagagcgaccugcuggcccugaagcucauccacagcaccgugguggacacggccgugcucuucccgcacuaccuggguuuccccuacaagcgcucccucaggaaucucgcggccgacuaccuggcacagaucauccaggacagccaggacggccacaacuccagcgaggacgcaagcgccugccugcagcuggugauguggaagguccgacagcgcgcccagauccagccacgccaccgguccgccucucccgccgcccuggccuguccuuagccccaggccucuuccaaaaccgccaucagucccgagagcucacccugcccaccucgccgcaaagcgaaagaaacuggagcagccggcggcaggagagggcaaaaagccaagaguaaccccaaccccccacucccggucccccggaaucccugccgcggccccucgggccuguccacaucccucugccccucccagaccucuguccuuccaccaaucgccucccgcagccccgagccgccacucccagucccccgagucccugccgcgcgcccucgcgccuguucacaucccucugcccauccgagaccucugucuuuacaccacuagccaccccacgugggacuuccauggcuucugaguacaaggccagccccccggcccaccagcuuucggaaugccugcuuaccucuuuuucuguagaggcaccacagggaggugggugaagcacuucggcucuggaguuacagaucuggguucaaggccaaauuccaccacuuacuagguuuguaauauuggacagauaacgucuuugcgcuucuaccuuuuggucuuuaaagugugaucaaaagagacuuagacucccacauaguaauaauaauaauaauggcaaacuuaacaccccacugucaacauuagacacaccaacgagacagaaaguuaaaaaaggauauccgggaauugaacucagcucugcaccaagcggaccuaggagacauguacagaacgcuccaccccaaaucaacagaauauacauucuucucagcaccacaucacacuuauuuccacauugaccacauaguuggaaguaaagcacuccucaguaaaaguaaaauaacagaaauuauuacaaacggucucucagaccacauugcaaucaaacuagaccucaggauugagaaacucacucaaaaccgcucaacugcauggaaaccguacaagcugcuccugaaugaguacaggguacauaacgaaaugaaggcagaaauaaagauauucucugaaagcaaugagaacaaagacacaacauaccagaaucucugggacacauuuaaagcaguguguagagggaaauuuauagcacuaaaugcccacaagggaaagcaggaaagaucaaaaaugcauacccuaacaucaccauuaaaagaaugagagaagcaagggcaaacacauucaaaagcuagcagaaggcaagaaauaacuaagaucugagcaggacugaaggagauagagacacaaaaaacgugggaugguuuuuuaguauguggaaaaauucuuugaugguuuuuccuugaaaaagugaaaccuaaauccacuccguuuggaugugggacgauuugcgguuguugcuuccuaaacauaaacuacguuuaggcugauauuucagacaaugaaaccuuugagugcccguagcgggaagaucucgguugcugagugcagggaaggaggauguaauuccaucauauacucucucugugccuaccgcauuuggaaccaugcgagugauaccuauuuauaaaauaaaauaaaccaagcacaaguacgaacuuagcaacacuauauugaguuaauagaacgguaucuuguauuucuucuguccagguauacuuauaaaugccugcagggauuucaccaccucaggguggagagacugaaugcuugugagggaauuaggaugguggaauauugguguuaccagggaagggggcgggauguuugaaaaugcuauguuuacucguucuuggguuccaauaaaggagaaacagggcacaggagucggaaggacuaguggcaauagugaugaaaggaccuccuuaucaugcuggcaauguuaauuacccagguguaggaagccauacacugaggcggaagaucgcaagucagaguggccggcaggcacaaccuccuggcacaccagaggcaggucuucaauacccacugguuuccccaacaggcugcguaagggacccugagccacagugaguuggucaaaugcuccugacaguguggagaaaccaacagacaaaacgugggugcaaaagugaugagaccccacacuuuacacucguggugacaaugaagcuauuaaguaacagcuucucaaccuaugcuguuuccuguuggaugcacauaauccauuugcacugcagacaauuuuaggaugugguuuacaguaagguggaugguaccuuauggcaaaaaucucucagaaauuuaugugugguuuuaaagucauuccaguccuagcacguugugcuuuucagagacgccauagcuguuuuucccuuuguaauaucaaagcaguaauauguucucuggaggccuguugggugaauuuaauggaaucaaguuaaguaggugccagaaccauugcuguuuucccuccauagcccugccacccacuguaaaaagguugaugagauuacuuaaugauuuccaauuaaguuguauuuccaaauaucaugauuuccauuuuaauguaguugguauggagcucugugagugugugcuucuuuuauuauggaucacguucagcuucuuuuuauuugccuccuagucauaauaguaaaacucuacuccucuacuccgaggagucccuaccacccaucucaucacuuuccagcccagcacucuucaugcucauucauuuaaagcauucaacauuguguaaaugaaucuuggaaggccaaagcuacugaauuuagcgaauuuguggaggcauugccacaaaucagccaggugaaguuucacacaaucgaagacugcacaacuccuagaaggcagcacuaugcugcaaacccagacggccacucuucucaccccucguccguuugcuguucuggauaaugagguucaaaagucaccuaggcaacugccaaaauagcugaaauggagaaagggcuucaggcuggugacuagcagagguccaccugacccccguaagcugcugaacaaguagggcugccagaaaugucccacuagggaauuugguagagacgaagacaugcucaccggacaaggguuccucccaggauacgcccgagcggaagaagcgggcucugagccacgcccuuucacccuccucuaccccgcccugggcuggugaaggugcgcgccaggauguggacuacugagcccugaagaaauaaguccuuccacuuugaccccauggaggauugccugugaggaacuuaaacgagucuaccagugucuagacacgggggcaggucuguccggcacagcagcucccucaaggaggagaagagugaggagaaaggaaacucaagucucaccauucuguccugggagagaagaggaggaucucaucucucaucuguccaaacaaggcaaggagacuuucucucaucuuuccaagcaaggcaaggagacuuuuuaucauuaggaaacaaaaagaauuuagaaggaaugaaagcagcccguaaggugaauuccuaaggacugcccauugaaacugacaaaauugcccuuguuugaugagaggaaugagcagagcauugauguggugaacaaggaucuagugagacuuucccagcauguuucuaccaaagcuuuaucuaagcuucucagaacacucuccuaauaagcagauguuuggccuuucagaaagucaacaagcaaaaugccuugagugucccaaaacacugaugccaugaugugggcuccugacuggccuccuuuuccuuugacuggaccgcugccaccucuugguagccaucgcuuucaugaugcuuugccuuggagaucauauuggugaagccauguuccaacugccgcuuacaauuugucagagggaugcgucaggaucgugaucccuccuguuuaaaauuuccacugauagcucucgucguaaaugcagcugaucugggcacagugguuuucacagccacugcaggauucaucuuccacaucuucucaccucuucuugaaacaagcuauacauucguaaagaguucauuucuuugggguaguguccuuacaagcuuuucuuaaaacgucaaugaugucuucaaucuuccacccaagcuucaccauaaauuugauguuuccucuugcugcaauuuucguggaauucauguugcucugacgggaguccuuuucaguggaugucucauccuucuuagugccucaaacuagaucuaguucagaaagguuaucagaaguuaggacaaguuuauuuuagugcaaaccaguggaaauccaugcauaguuucuucaccaugugcauuuucuaugaaccuuuggaagaccaccuguguugaacauugcccaaguccugggagagaagugggugcgguccgcuuccuguccucaauuugcccgcagcggcggagugcacagagcagggaaaggcagccccagagggaucccgcccuccagcaugcagcagacugcuggcccaguccuggcuccaaggggugcugugugggcccaagcaaguugaccaaccucccugaaccuuaauuuaauccuagguagcccaauuccaguagccauuauaggacugcccugccgggacaguuacuuaacucaggaaaagcaaccuagcuccaaguuuagcaaccgggaguuccaguugauuccauuagcgcacccccugaggcauucccaagcuggagucugguggaagaugaggcucagugugauuggacugaagcaccaaccuaucaaggagaagucccacccagucugcccugugccuauauaaaggcgacaaguggcggccgcagcacucauugaagccgccaguugggagaggagcagagccaggccggugcucccgaaggcagcaagauguugcgagccacagcucccugcugguuccccccuggauacccagaagcuaagaagguggccgaggaggcggcccuggaggcaagccgccauuugggaggggagcagagccaggccggugcucccgaaggcagcaagauguugcgagccacagcucccugcugguuccgcccuggauacccagaagcuaagaag

SEQ ID NO: 1388 - RNA, 838 nt, Homo Sapiens
ggggauugggcagugcaccagaagaaucuaccacauucccgagguuuacuucaagaugcaauugggccugccugucaagccuuugcaguaaacauuccaugcauaucuaaugagugacacaaacacagcuugcucugucccaucagcuuccuccacagagccugaaccggcaccagcuccacucugcaggaaggaggauguggaaaugaagaggcaggcucugaugacucaacacagccacccaaacaggcaaucucccugggacuugcucaggggauuuuuaccccccuacaugaagcagagaaacagugaguuuccuccaagaugucaaauccaagauggguguuccugaucugccuguagcucuccuccaacccagacuccuuucaaacugugccuccaccaucuucaauauggagcuuccaagauugcccugcugcccugcaucaagccugcaaaagaggauagggggucaggccacucauauuucauuggcccaaauucagucacauggccacacucacugcaagggaagcugggaaauggagucuagcucugugcccaagaagcaaagaaaaacagauuugaugaagacuuagucaaucucugcaacaaugaaacagauaagaaggcaaaagaaaaagaauuuuacaaccugaggagggagagaaaauucaguuaacaaaaagauagacuacaugccaagguagucugcagaauucuaccuacccaaauuauguguuaaauugugaaagaaguuaugauaaaaauaggaugagggugaaauuugaaaaaugcucuggggacacauagcacacuccuucccuggugacacagu

SEQ ID NO: 1389 - RNA, 9777 nt, Homo Sapiens
agagcgcagggagcagccgguggcucggcggcggcggcggcggcggcggcggcgucggcgucgucuaccuccagcuucuccucccuccuccuccgucuccuccucucucucuccaucugcugugguuauggccugucgcuggagcacaaaagagucuccgcgguggaggucugcguugcucuugcuuuuccucgcugggguguacggaaauggugcucuugcagaacauucugaaaaugugcauauuucaggagugucaacugcuuguggagagacuccagagcaaauacgagcaccaaguggcauaaucacaagcccaggcuggccuucugaauauccugcaaaaaucaacuguagcugguucauaagggcaaacccaggcgaaaucauuacuauaagguaauucuaccuuucuguauuacuauauaauuuauuacaaaacauaaauuccauuuucauuuauuauuacuuaacaugcaguaauauaaaaagaaggcuuuucaggagauguaauaaagaacagcuauuagcuauuggugucaucuuaagaguaagaguaacagcccaucugguauguguuuugaguauuuucuaagggugguaauguauuugcauugaaucaucuauauucuucuaagcuacuuuuuaacaaaauauagacauuugcaaaauagccuauuagggucaagacuaaccuuuggcaguggaacaaacaaauaaacaaaacucauuaauucacuuggauaucuagcucuuaaccuuugucucauuaguagagccuucuaccuaaaugaguuaaaacacaauuugucaugccugucuguauauguguauguauguauaaaacuugaaacaaacugauaauggagaaauacuauaucuagaaaaaucuuuguuuauaacuucgaaacaaaagaacauuuguuaagaauacaaaugaaaggcauuccuaggggaaauagcuguaaguuuaagauucuaagaaugaaugugacauauaaauaaggaagguuaagauuaaauuuuaaaacauuuagcaaauuacuugcagagaaaaacaguacgggaauaagauuguaaagaauauauuuaguagaacuagauacugcuugcuuaggaaaauucuaucaaggccauuaggaaaaaaauauuuaccuacaggggaaaaaaaaauagcccgaaugaagaacugcaguuggaacaaaacacaaauaagaaugucauuuccaucacagagacaguguagcacaaaggcaccuucaacauguuuucauguguaacauuguauggguaggaggcauagaauuuuagauuuagaagagacuuuggagaucauaaacucaaauuccuucauuuuauguuuuuaaaauaagacuuauacauuuagccuacuuucucaucuuuuuucaucuuccuuuuuuguauuuauuaacugaugaggaaaccaaucucucuugagaagcauaacugucaucuaucuccuuuuuuugguggaaaccacaaacaagggccauaguuuguuuuccuuuuauuuuccucuacccuacauuaccucuucuggaaccccagagcuuggcacauacaaaagcuguuguucuccuccuccaugcaguguuuuucucuugccugauugagugguagaaugcaccauuaagguuaucuuucuguaacagggucaguguuuaaauguaaauaauauaccuauuuucuguuacuuguagugugacuaaguauguuuacaaaauaacauuuuuaccacauauugggaguuuuuuagcauaaaacuagaauuuauagagaccuucaccuuuuaaccuaaaaauuuaacuuacaacuuauagcucaguuuuguaaaacuugaaaaucuuaccagcacagaggagauuacaugaaauacugccaucugguuuugauaauguauugcauccuugagauuucaugagguuaagauacacuaaaaaccaagcacaauacugaaaugcagaauaaaauugaagugagcccuacagcuaaaggaaaauuuccugaauuuuagaagggagcaaugaauuucgauguauacagaucagaaggugauuuuaguaauuguucagauucuuuacugaagucauuaucaugguaauaccauaacuuuaaaaagaugacacaccugcauauacacaaagacaaguuuuacauaugauuaucauugcauaaucuuaaaugauucaaaagaaucauaugcauaauuaaauguagcucuuuuagacauacaaaugagucaguauuaggaaauauuaaauuaacuuaccauguaaacaagucaaaagaaaaaguauaugauuaucuaguguacacagaugcuuugaagcaucuugguaaaaaagaaaaucagcauucauuccugaauuuaaaauaaaaauuuuaaauucuuaguaaaauggaauuagaaacaugauuuuuuaaaaucuggauagaagagggaaacuaaaguuacggaguaaaaacaauacugagaacugucuguauaaaacuugcuuaagauggugaaauaaaggcauuuuuacuucauuccucucccuuggaacccacuauaaucaacaaaggccaccuuauccauggggaagagaggauugaauaccagcacccugcuugaagccaaggacuagggacgggcaauuuugcuccagacaggaggcugaaaaaucuuccaccaaccacagccugaauuuauauggggcugagagcuuagagagcugagagggcauaaccuaacaaacaugaauaacuaugucaccugcugacuccaugaaaggaucuguaauacucugaaccaucauuuaagacuuguucuggaauguagacccaaguaggggaacauagaagaagagaggauuaaaaaaaagagagaaaaccaaaaaacuuccauaaaauaaaccuguaaaccaaaauuccagaaugugugaaaaaauugaaugcugagaaaaacagccaaacaaaauuaaguuggaacucaaauuuacuccaggcauuuuaagauguauucugucaggaauuauuucuuaacuuucuuuaugccacggccaccuaguauucugguaaaaccuauguauucuuucccagaauaauguguuuaaauucauuaaaaaaaauacauagcauuacaaagggaaccaauuauguuaaaguacagcuaucagauauuuuuuaauauuuguaauguaauauaugcuuauuuaugaacacauuagcaaaaucaagugguuaauuucaaagaaaaaauuuuacguguaaauaguauuuuuagauaucuguaaaaacugaaauguaacauaaaaauaucucuaauuuugaauagugguggaguggccagugcuauaaauacugucaugguuuguuguuuauaaguguaggaaaugcuaaauuuuaguaaaagguuagugaaaauaaagcuuuaaauuguuucuacccuauuugugauuuuugaggggacaggagaaacaccgaauauucuuacuuggacuuuguuagaaaaaaaguguguuucagcauuucaguuaaaauaucaaaagguagccacugauuaaaaauaggaguaauauugagcaguuaacagaggaaaaggaacuuuaaaaauauauucaaaaaagacaggaagcuagaugugguggcucacgccuguaaucccagcacuuugggaggcugaggcaggcagaucacuugaggucaggaguuugagaccagccuggccaacauagcgaaaccucaucucuacuaaaaauacaaaaauuagcugggcaugguggcacgcgccuauaauccuagcuacucaggaggcugaggcaugauaacugcuugaacccaggagguggagguuacagagccaagaucaugccacugugcuccagccuaggcaacagagugaaacccugucucaaaaaaaaaaaaaaaaaaaaaaaggaaagaaggaaaaugagaacucucucccaaguagaaagguuguaacacaucuaaaacaaaacuaauacagaaugucuaaaaacaaggagaugggccagaugcuguggcucgugccuguaauccuagcauuuuggaaggccaagguaggcucaggaauucgacaccagccugggcaagguggugaaacccugucuuuacaaaaaauacaaaaaacuagcugggcaugauggcacguugccuguggucccagcuacucaggaggcugaggugggaggauuaccggagcccaggagguugaggcugcagugagccaugaaugcaccacugcacuccagcuuggguggaagaaugagacuuagucuuaaaaauaaacaaaaacaaaacgagauagaaaagguuaguuuuggagcuacucaucaagagaaagcuaguguaggaagauuaacauccauuguaauugagcuuaaggcacaaaauacuaguaacaauugggguauucuaccaggaaaauaaaccagcaguaaauuucauuuacuuaauuacauagccuaaaauacaugcaaagcaaaauguggagaauugcccggcaaauuugaccaauccacaguugcagugggagauuuuuaacacaccuuuaauacuuauuucaacaaagaauacacauucuuuucaaagacauguggaacauuuauaaaaauugauuauguuucacaucacaaaggaacucuuaauacauuucaaagacuguacaucauucagauuguguuuucuuaccacaaugcaauuaaaauaaaagaaaaaaauaaaccuguauguuuagaaauauauuccuaaauaacuccugaauuaaagaggaaaucacaaugggaccaaauauuuuuuaaauaaccauagugaaaguaauacauauuaaaacuguuagaauacauugaaagaauacuuagaaaaguuuacaacuuuaaugcauugauuuaaaaauuagaaaauaaauaagcucagcauuuaacucaagaguuaaggaaaagaauuagaggguaaauuuuaaaguagcaguaaagaccaggaaaauacgcaauaaaauucaauaaaacaaaaagcugacuuucugaaaaacucaggaaaauagauaaaacucaaagcaaaacugaagaaaaauuuucaggauuuugauauucaaggauccagaaggugcaauuuggacugguugacaauagaaacauacaagaauauugaaaguuacagagcuugugguuccacaauuccaccuccguauaucucuucacaagaccacaucuggauuagguuucauucggaugacaacaucucuagaaaggguuucagacuggcauauuuuucagggaaaucugaggaaccaaauugugcuugugaucaguuucguugugguaauggaaaguguauaccagaagccuggaaauguaauaacauggaugaauguggagauaguuccgaugaagagaucugugccaaagaagcaaauccuccaacugcugcugcuuuucaacccugugcuuacaaccaguuccaguguuuaucccguuuuaccaaaguuuacacuugccuccccgaaucuuuaaaaugugaugggaacauugacugccuugaccuaggagaugagauagacugugaugugccaacaugugggcaauggcuaaaauauuuuuaugguacuuuuaauucucccaauuauccagacuuuuauccuccuggaagcaauugcaccugguuaauagacacuggugaucaccguaaagucauuuuacgcuucacugacuuuaaacuugaugguacugguuauggugauuaugucaaaauauaugauggauuagaggagaauccacacaagcuuuugcguguguugacagcuuuugauucucaugcaccucuuacaguuguuucuucuucuggacagauaaggguacauuuuugugcugauaaagugaaugcugcaaggggauuuaaugcuacuuaccaaguagauggguucuguuugccaugggaaauacccuguggagguaacuggggguguuauacugagcagcagcguugugauggguauuggcauugcccaaauggaagggaugaaaccaauuguaccaugugccagaaggaagaauuuccauguucccgaaauggugucuguuauccucguucugaucgcugcaacuaccagaaucauugcccaaauggcucagaugaaaaaaacugcuuuuuuugccaaccaggaaauuuccauuguaaaaacaaucguuguguguuugaaaguugggugugugauucucaagaugacuguggugauggcagcgaugaagaaaauugcccaguaaucgugccuacaagagucaucacugcugccgucauagggagccucaucuguggccuguuacucgucauagcauugggauguacuuguaagcuuuauucucugagaauguuugaaagaaguuuucaguuugaugcaggauaaaugggaccuggcagaaguuaauggcagagaugucccuguggagacaaugaccuucagucccaggagaauuacaaauaauagauuuaacaacuuuuuacguaacagauggcuaauagguggcacacagaugcacaguaucguaauaaccauuacugcaucuuuucuuuuuuuuccuuuuuuuuuuuuuuguuguuuguuuggagacgggagucuugcucugucacccgggcuggagugcacuggugcgaucucagcucacugcacuccgucucccagguucaagcgauucuccugccucagccucccaaguagcugugauuacaggcgcccgccaccacgccuggcuaauuuuuuguauuuuuaguagagacaggguuucacucuguuggccaggcuggucccagacuacugaccucgugauccacccgccuuggccucccaaacugcugggauuacaggugugagccacggcgcccgaccacugcaucuuuggccaaguguaaauggccagaaaacuuuuuaccacauugcaacaaaagagcacaaugaagagucaaagaucccagcugggcgcaguggcuucaacguauauucaguaaauacaguauucuuaggaguuuuuaaaucuuguauuauuucucccuuuaccuuuuacagggauuuucauuuauuaaaacucagugaucuaggcuucuacuagcauaaagcccuaugaagacagacugccugcgucagcuuuguauucccacuguagggauaauacauauauucaguaaauguuugucaaaugacuaagcuuuaaaaugaucaaauaugccaagacucagauuguuuuaauuacugauaauagaaaauuguucuuuuucuucgcucccccuuuuaaucauuuuucuuuccaucuacucucaaagaucauuugaaacacaguugucaagaguggaagcagaauuguuaagaagagaagcuccucccucguauggacaauugauugcucaggguuuaauuccaccaguugaagauuuuccuguuuguucaccuaaucaggcuucuguuuuggaaaaucugaggcuagcgguacgaucucagcuuggauuuacuucagucaggcuuccuauggcaggcagaucaagcaacauuuggaaccguauuuuuaauuuugcaagaucacgucauucugggucauuggcuuuggucucagcagauggagaugagguugucccuagucagaguaccaguagagaaccugagagaaaucauacucacagaaguuuguuuuccguggagucugaugauacagacacagaaaaugagagaagagauauggcaggagcaucuggugggguugcagcuccuuugccucaaaaagucccucccacaacggcaguagaagcgacaguaggagcaugugcaaguuccucaacucagaguacccgagguggucaugcagauaauggaagggaugugacaaguguggaacccccaagugugaguccagcacgucaccagcuuacaagugcacucagucguaugacucaggggcuacgcuggguacguuuuacauuaggacgaucaaguucccuaagucagaaccagaguccuuugagacaacuugauaaugggguaaguggaagagaagaugaugaugauguugaaaugcuaauuccaauuucugauggaucuucagacuuugaugugaaugacugcuccagaccucuucuugaucuugccucagaucaaggacaagggcuuagacaaccauauaaugcaacaaauccuggaguaaggccaaguaaucgagauggccccugugagcgcugugguauuguccacacugcccagauaccagacacuugcuuagaaguaacacugaaaaacgaaacgagugaugaugaggcuuuguuacuuuguuagguacgaaucacauaagggagauuguauacaaguuggagcaauauccauuuauuauuuuguaacuuuacaguuaaacuaguuuuaguuuaaaaagaaaaaaugcagggugauuucuuauuauuauauguuagccugcaugguuaaauucgacaacuuguaacucuaugaacuuagaguuuacuauuuuagcagcuaaaaaugcaucacauauucauauuguucaauaauguccuuucauuuguuucugauuguuuucauccugauacuguaguucacuguagaaauguggcugcugaaacucauuugauugucauuuuuaucuauccuauguuaaaugguuuguuuuuacaaaauaauaccuuauuuuaauugaaacguuuaugcuuuugccaacacaucuuguaacuuaauauacuagauguuaagguuguuaauguacaaaaaaaaaacccuuauacucaccugcguuuucauuuguuugacauuugucuauuauuggauuucauuaucauaugaacuugucagugggaaacaaacugucuaaaaauuuuucucuuacguuuaacauacaaucaugugaaauuuaggcagaguucgauaaauuacuggcaaaaacaaaacucuuuuauaaagauuuucuaauguugacuuuaauacucuaacaugguacaaaccaaaugguaaaaucccaagucauuucuuuuuucaucucuauuuagcaacagaauuaaguggaugaagauauucuacuaugcauuaaaucuugaacuuuauaaaacauguacaaaaauuguacaagauaaguuccaccugguaaugucuuucccuaauacaggguugcgcuugcauuggacccuagggauuugcacuaaaauuauaucaaggucucagaugagcuuagugcacaagcacuaucacuuuaaauacuauuauuugcuaccacagcaacuauauauuuccauagcuuuuggcugggggcgggggacauuuuuauuacaacuugaaauugcuuugcugguuucauauuuauuuguuguauuuaaaaaauacauuguuguaagagugauuuuuucaauauauuuuauuccugggggggaucaugcuacacucucaaaagaaaauuaagaaaucauucagaucauccccccuuuuuaaguagugugaauugcaaaacccaacauauuuuuuuuacugucaguugcgguuuauuuauucuuuaacugucuguuuuaguaguuuaaugauuaugaaaaauguaucugugugugauuugcuauuuauuaaauuuuaaguacuuugcugaaugucauuuuaaagcauguuugaagucuuguguauuugucuguguuaaugcugucaggaggaacugacuaagauguuuuaauauguaucaaaaauuaaaaugauuuuuuuuauugccuugagguacuuuuuaaaucaaa

SEQ ID NO: 1390 - RNA, 2342 nt, Homo Sapiens
ugaaccaccccaggcccuuugcaccugcuauucccucuccucagcaugcucugccccagacaauugcaaugcuaacuucuuacuuccuucagguuucacucagaaaugacuuucucaguggggucucccaugaccauuuuauuuaagauuucaacuacuuugccaguauuucacuucuccucccuugaucuuuucuuccaagcacucacugcccucuugcacacuguaucuuuuacuuauuuaucuuguucaguuucugccugccucaccugccucaccacaguguacauuucacgagggcagggauuuugucuguuuuguugauugcuguagcccuggcaucuugggcagugccagcaccuguuagcauuaaauacauauuuacugaaugaaugaguggcuucaugcuuaaaagcaagaagagagaccuucauagagaaguaggaaaaugaauuguugcacaaauaaagggccauguaaugagagagagagagcaagagaaagagcaaacaauuaaggagcagcaguggcuuccugcaggggagaccaaugccuucuguccucagcggaaacagcuuggcauucuuccaauugaugaauggcauggaccaggagcacuaguuaucuucagcuucugagcauccgaauaaauaaacauacaaaugcauaacauaaaauaaauucaaauuacaaaugagaaaaccaaucuagguuaccggcaaguccuaugacuugauguggaggccuggaagugcauccuugaaucuugcaaugcagugagccaaggagcaaugagaggccacaugaauaaccgggccagugacaagacacauguccuccuccuugcugguauacaccagaaugccccgcaugcagcgaaugcucaaaaaguguugguggaagugacagaauuccaucaccauuaaacacaaccaguguugcgguugacaauggcacugaagcaggugaaaaauccguacagcagcuucugucuuugaagaguuugcagccucuugaagaggguuuagagguuaaaaaaaggacccaggcugauagggccgcuaccauuuggaaagugacaagaggaagagagagaaugaaacaacaguaagcacuggcucucagcuucuaccugaagagacaaacauugcuuucacuuacauuucacuggccaaaucaagcccauggcaacaauugaguucaaaagcauaaggagguaucuggaaggaagagaaucagaaaauuucugaugagccucacugacuaccuucagggcaaaaaggaagagaggcacuccagaucagagaucugcauuggaaacuccuugagaaccagaaggguaugcuguauuuuuguaacugugaggagcccagaaagacugaagcccaaauaaaauuccuuuauucaauauuuguuucccaucuuacacuuuuucagaauagauauucccaugguagaaucaugggcugacacuaucacauuauaaaauuuucucugguucugucucuuccccucaggaacacacauggaugauucuuauuacuuuaugcccacauuaaauaauuguauacaccaugaacuggaggccuuguguuuugagugaaaagcuuuggauuugaguuuguguuuccaaacacacuucugagguagaaauugucaagagcuuucccaaacucuuuuuuuaauccuccugagcucaccaucucugggacugucuugcaauuggacagccaugcaauugagcuucagccaaugaaacaugaguggagggcgugacacacaaccugccauguucaagccuccauacucuuucccuccuccagcuuugugcugaugaacauggucaccuugaaagguguguugaauauggcagagccagaaaaugcaaggagcuucuucucuggaucaccacuugaagaagagccacuugcuccucaggaacccuauuuuggacugacguuuaauacaacauggaagccaccaaggcuuacagaaugugcuuuccagagcugugaccugaacuguaccuggggccuuuugagugaggcuggaacuggaguggccuggaugcagagagcaguguccuaaggcugugcagguugcaagaaagcucaaguagccuauggagaggaugcaaggcuuccagcugaugcccucagccaggcucaguagcagccagaacuagccuaccaacgaaccugcugaucaugugcauaagccaccuugaacgucgauccuccugccugguggagccaucccagcugaugccacaugaagcagacacaagcugucccuacuaagcucugcucaaguuggauauucaugagugaaauaaaugacug

SEQ ID NO: 1391 - RNA, 4678 nt, Homo Sapiens
ucuuucagguuggcugcagaagguccgaagaaagaggaguuacuggaggaaaaagugguucagaggugacuauucaaccgcauaagagauggugaaaauuaaccuaucaccacugcuaaugaacaucacccuauggagaaccgagacacaaaagggaagauucagaaugugugacuuguauaaaauaaaaccaguuucccccgaccccaacaccuucuuugaacaucucuuucuccaccucucaaaaaauuuccuacugaguugguccucuagugaaaagagcaguuaauaagauggaaagcaacuggacguggugaagaaaaagccagcgaacuuaggggugagacugaagccccucaggguggcugagcugcuauuugaaaaauuccuucaagucacgugcggccugucaagagaugaggugaaggaagagaaugauaaauaucuaucuccaguggaaggaucauuuugaaagaagggcuguuagauuaaaaaccaagcuagccagggaacguuaaaggaagagaaguucucacaagcauuuuaaugccaagcauguguuccaacgagaggaacacaggaaagcucuucagcagaugagaaaaugaaauucggcaucacuaauucauaggaaugauaacaaaaacggcagugaagaaaaucugugcauuuuaaaaaaugcauguuuuuugcuuaguguugucccuuccccuccuggcuuuuaguauacugcauucauuaaaguagcugagaagaaaaauaguagaugcuguuaacgucaggccugagagcuuccauauccuguguugcguugaguuuuggguuuguuuccuuauucacugucuucuagaucucagacccuagcagaaggugaucucucacucucacccagguuggagugcaguggugugaucacgacucacugcagucuugaacuugccaggcucaagcaauccuccuaccucagccuucugaguagcugagaccacagggaugugaagagacagggucucacuauauugccccggcuaaucucgaacuccuggacucaagcaaucugcccgccucagccugccaaaaugcugggauuacaggagauccccagaggcaauuguccaccugacuucagaaucagaaguagcucugcuuuuccugagaaguggugcggguuuugccuuauggaugcuaacugagacuggaacauguucccuuuuuuguaucagcugcugguacaaaauugagaguugagagccaaaacuguacccuuaucaccugucaguaacuuaaggaggaagucagcuaccaugccuccaggacacucaaguaaccccauggagaugacauugcagagaagaacuggucgaaagccaguacccacuuugccaucugugugaacaauccaccuuugaguggguccuccagcccacaucaagccuucauauaacagcaguccugaaggacauuuuauuguaaccucgugaaaaucgaaguaggaacucaccagccaaguugcuccugaaccuugcagcauaagugcuggauaaugauaauguucagcauuuauugaaugcuugucaugauugugccagacacuguggagaagucaggcaccauguuaugaggacacucaagcaacccuguagaaaguuccauguggugaggaacugauaccuccaauccauggccaguaccaauuuacuuagcaugugagugcauccuggaaguagauccucuugucucagccaugccugaagcugacugccaucucaugggaggccucaagccaggacuguccaggcgagcugcucccauauucuugauccacagaaacugugaaauaauuaauguuuaugguuguuucaagucacuuacauuuuaaguucauuuguuaugcagcaguagauaauggaaacucuguaaacaggagcccagucuggggaggauggagauaguaaucaggagaggcuuccuggaggagguguuagcugagcuaugucuuguagaaugaggaggaguucugaguaggaguuagugaggcagagaguguuggggugcuaaggcuuuccgggcaggaggaacaauauguauaaaggaccacuucaggccccaucuucucugcaaagucuucccuaaccauucacugccugagucauucauuuacuuacucauucauucgacaaagcuuugaugagagccuccuauguccugggcuccaugcagaguacugggguugcuguaaguugcauauucugagacugcucaguuaggcauagaaaacucaaaugcccacaagggcuaggcaaguaaugcaagccagggaagcugaguggugcacugggagucaggggugaggccagagagaagcggagagcccaauucccaagaaaggcccaccauuucucagcuccaguugucagcuggcaugccagaauguaagcccaaaucuggccagaucuuccaauuuaucaagauaucuagaaauuguauuuuaguauaaagucuccuaauuuucaaaaggcagccagcccaaacuuguugucaaauuucucucuuuccagccuucuguucaggagcuccaugaguuggcugguggagacuucagcuucucuccugcgcugaccgcaaaacuuuguccucugccuucugguuagcuugaguccugugugacuggugcaaugacuaauugucucaauaguuuucuaagugguggcauguaacacuugagcuccacugaucucccaggaggggaaagaaaguugguguuuauucacaugcagacuuccauagcuccucagcaaagcccucuguagcccaacaccauuaugguaaaggugucgaagcaaaauuacagaauguaagguaguuaaucugguggacagugagcacuuugugcauuucugaagccacgauaccuacugauagcauccaggguuggccaccuagugacuuuucaagacacugguauguggcugugggaguguccauaucuuagaaagaggacagugaguuuauggaagccuuccugugugcaaacauggggcugugcauacagaagcuuauuuaauccucccaacagcccuggaagauugguguuaucauuguucucauuugcagaugagaaaacagagucccagggaagcuuacugauuuguccagggucuugcagccaauaagaggcagggcaggcaucucuucugggacuguuaagucuauguucuuaucuacucugcuguaauuuuucucccuggagcugaaaaaaagaaagcacugggguuucugaguucuuauuggagaggaacagagcaaugacaaucugaucggaggagggucaggcuguggggcauguaaagcagugccuauagagcaggcacagcuuauuguuuuguuuuguuuuuuuuucucuuagaaugaggugcuuucccuucuucuccuccuacccccaaguaagcccuuggugaugccacugagagggaccuaguuaugaaaggaauuucaaggacaacccauaugucagauuuagugacauaguuuguacugagcuugugaguuauuagucaggugagucuuuuucucuguuguaucauguaccuugaucuguggcgggaagcggcacaaaggagaggaaaugccauaggcuuuggagccugggaaauguaaguuucaauccagauucacucacuaacuaggugugugaccuuggacgcguuguagccugucugagcuccagucuccccuuccggcacacgaggucaagaauaugcaauuuacagcaaccucagggcucuucguggagccugggacagaggaggcucucaccaaagccuugucaaaugaauaaguaaaugaaugaaucagucaaugaaugguuagggaagacuuugcagagcagauggggcuugaagcgguccuggaggauuuaauacguggaaaagaggagggagaaaauugaagagagggaauuguaggcagggaaaugacauaaccagcagcuugguggagagaauuccaggcuuagaggauaaugaaaggccaauauggcuucugguggaggagaggauggccuaggaggggccugcaccgacuuccccauccugauuaaauuuccucaguggccaaagagcgcuaggugcugacacuaauaguuccuuuaacagggccuuucaucuccuauucaaagugcuuugcaaguguuaauuaaaucuccaaacaccucaugagauaaauauuauuuauccaccuuuuguagaugaagacauuuaggcacaaagagcggugauuuucccagggcaaugucuagauggguguccauucccaccuucauuccagaauugccaaaacaugucuuuagaagaaagcagaaaaaacaaaucagaucuuuuuugccauccccccuccuauacccucauacauauaaaaaacagaaauuaggacaaaaaaaagauguuauuucagauauuucuuaguuauuuuaaaguccccccaaugcauucucaaauguauaccucccuucccaauuuuuuagaacuuacagguuacaagguugagaaaauuguucaguugaaugauucacagguauauucaggccuaaaaauccaugcuuuauauuucucgucuguaacacgggaccccucuuucagaguuguugugaggauuaaaggaguaaauuuauacaaaagca

SEQ ID NO: 1392 - RNA, 1179 nt, Homo Sapiens
caaaugggaaaaaaaaaaaaaaaaagggaaguagcagguggagauaauuuaaauagcacagggaccccugcuuaccaaucccuccacagaguuuugcccuggaguaagcaugacaucagggugcuugcugcuuccuccaguggcccgagcucugugugccuuuguugaacaagguuuucguggagcugaggugacucucaugaacagagaauaccuguccuucauacagagaagcacccaaaugcaaacaucuacuuuuucugguguucaaccagguaaaccucuguuuagcaagaaacaucauccccagaguggggacugucuuguccuuucagaagcuaguacccuaagcaagacucauaaggaaggucgggccucccuaggucucuguuucuucugaacagugaugagcuaggugcagagagaguuaaaggucacuaugcagcugacaagugugaccaguucccaguaaauuccacuuggcugggguuucagaggugagcaaggcaggcuuuuuacucauuacacaagaaucuagacaucccuuuaauuggguggcauucugggugcuaaaaggaaggggcuuugagaggcaaagaugaugggauaucauaaauuuuuuuguuuccuuuuuaauauagcgcagcuccuauacuuaagauuuaacuuugaaauguagcauagcuaagaucugguccaaaaagauuucugauaucuccaugaauccuaguuagggauugauaggaaaaaaaaaaucuugugccacagcuucaugcuauuuuuaggaaccuuucugaaaccaguggcagcccaaguuagagcccagcauuaaguccaccucaugcacaucauacaguugcagcuuaugguaaaagcuuucugcaaagcuuuucugcuccuggguuaaggccuuccagcaucagucacauguaauuaacagcuacauugugugcuuacuuuuugcuagauguuucauaaacauuaucucauauaaaccucacaauaacuagguauuauuaucccguaucccuguuuuacagcuguggaaagugaagugaaggauuuuugucauacagccaguaagugccagaacugacuugaaccuagcucucugucuugauucaggaacuacugcucuuuccauugguggcuccuggcuaaucaaugugauagucuuug

SEQ ID NO: 1393 - RNA, 3378 nt, Homo Sapiens
uugaccgcagcccaggagcccaugccgaagagagccaccagcagggccagacacgcuuuggcucuccugggaagugaagacuucuucuagcuugaaagaaacagagaaacagauaggaugcagagccggagucagaacagggugagaccaggggaacugggggagccccgggcaggagcgcagauggggaggauuggcuaaaacguacccagcgggaccgccggcaggcagggaagcaggaagccggcccgagucgcugcggccccaggggaggaggccgaaggagcgaguggagcccuccucuccagggagaggcggggcuggagucaacgccaccaccaccccaagccggacgccgggaaagggcgccuaccaggaggagccacgcacaccccagggcuucacggugcccgcgaccgcaagagccaagucagaucccaggggaguggccgggacggcucugcucggaggggcgccgcccucucgguaccgucaggugggcgacucgggagccguccggucccugcgccucccggucccgcgcccagugcgcucccgcuccagugccggcuucccgccacgccgggacaccgccguccggcccagggacgccaccucaguccggagcgcgcaggacccggcagcagccacgacccgacucacccguggcgguuccgggcccgcccccggcauggcccacgaccggaagucccgccccggaagcuggucggcgggcgggcgggcguugagaggaaccgggggguugucggucuauaagccucgcccguuccgcucccuggggcuuccccgagcgccgucgguggucauggcugccccagccucccggcagguccgacgcagagcccgggcagcgccgcggccccgcucggccgaggacugguggugggaccggcuggcgccgaggggcucgggguaccaccugcugcaguccgacagcaugcugcuggugcuguccgaacccggccccgcccggccccgcgcacagcggcgcgcuucccgccgcacuccccggcagccgccccggggccccagcgccgcggccaagcccaaggccgggcucagguccgaggcggcggccgcgcccgcacccgcaccggcacccacgcccacgcccgaggaagggcccgacgcgggcuggggagaccgcauucccuuggaaauccuggugcagauuuucggguuguugguggcggcggacggccccaugcccuuccugggcagguaacgcuggugccgggcccgccgccgagcguagcggcuugggccagacgugguccgagcgguggcccgggcgggggcggagggcgaaagcaucggagcgcgcaccgcucaguccgagagcgcagccccuuaggcgcccaguuggagucccaggagcccggcuuugagccggggugucuacugcgcugcgagaggggggcaucgccuacggaggggccggcacccucagcacgcuguccucccagggcugcgcgcgugugccgccgcuggcaggaggccgcuucccaacccgcgcucuggcacaccgugacccugucguccccgcuggucggccggccugccaagggcggggucaaggcggagaagaagcuccuugcuucccuggaguggcuuaugcccaaucggugagggguucccucucuuccuuaccccuggcuccaggcuccuuccgucucccugcaccaagguguugggugggaaggacucgugugggaacauuagugcagcucugccuccgcugucggcccagguuuucacagcuccagaggcugacccucauccacuggaagucucagguacaccccguguugaaggugagagcuccaggcuguccugcacaucagcugugacacucugggacuguucaguacucuaggaagugggucaggcaccuugggggcccaacgcugcuccguggggaugucugcuugccugccugguucucuuuuccugcuguuuccuccagcagggagguaucagaggcggggacacccaaguaggccuggcaugggcagaaaggaggucacagcuaaggcgguagagugggguuggcaccagccacuugucuguuucccuuguggaucuuagccugucgucucccaaccccagcugccccucugucuccccgcagcugguaggugagugcuguccucggcucacuuuccucaagcucuccggcugccacggugugacugcugacgcucuggucaugcuagccaaagccugcugccagcuccauagccuggaccuacagcacuccauggugagcccugugucccaaggggcccugaaaaaacccaggccggggugacgggugcucuuguauuggggccccagguggaguccacagcuguggugagcuucuuggaggaggcagggucccgaaugcgcaaguuguggcugaccuacagcucccagacgacagccauccugggcgcacugcugggcagcugcugcccccagcuccagguccuggaggugagcaccggcaucaaccguaauagcauuccccuucagcugccugucgaggcucugcagaaaggcugcccucagcuccagguaccuggcgcccugccucucccaccugucacacccucccccaucuacagccuggaccuugcccccaggugcugcggcuguugaaccugauguggcugcccaagccuccgggacgagggguggcucccggaccaggcuucccuagccuagaggagcucugccuggcgagcucaaccugcaacuuugugagcaacgagguccugggccgccuacuccacggcucucccaaccugcgcuuacuggaucuucguggcugugcgcgcaucacgccggcuggccuucaggaucugccaugucgggagcuggagcagcuucaucugggccuguauggcacgucagaccggcugacucuagccaaggagggcagccccuuuuugacccagaaguggugccauacacugcgagaacuggacuugaguggccagggguucagugagaaggaccuggagcaggcccuggcugccuucuuaagcaccccugggggcucacacccagcccugugcucucuuaaccucaggggcacccgggucacaccaagcacugucagcucugugaucagcagcugcccgggccugcucuaccucaaccuggaguccugccgcugccuuccccggggucugaagcgggccuaccggggccuggaggaaguccaguggugucuggagcagcugcucaccagccccucacccagcuaggcagccacagaccugggacaccucagccagcuugcccacccuccaccuuugcccaauuucagauauuugagcauuuuguuaaaauaaaacauuuuuaggaguu

SEQ ID NO: 1394 - RNA, 734 nt, Homo Sapiens
aggccuaaaaaaggguaguugugguuggcucugccuuugcugucuuuaccugaauagaggucaggcccggguccaggggagcgucccacggucccuucagcagcagcaucucuaggggaaguggccggcugcagggacugcacggugaggcaaucugugagcaggucuggauggagcucugugcuggaccgcaacuaagaggacaaaacggaagagacaucgauaaggagagccgguccuuggaauauuuuccugggaaggcaucaugcucuaucagugcaacucagcccacaaaaauuuaucaagcagcaacuacggguccucugaacgggccacaccacgguugagccauugugaccccugcgacacacagguccaggccuccuggagucacaaagcuuugagcaacaggagaaccacuaaagaagaagaaacagcuagcuccugccuuaacugauuaaccgaacuugcaacauuccaccauugugauauguuccugcccuacccuaaauaaucaaucggccuugugauauccugccaugugaacucccuccaccucgugacuacgcaccuugugacauucuuccccugcccgaaaagacugccccaacuguaaccuuccacuaccuaucccaaaccuauaaaaccaguuccacucccaccgcccuucgcugacucccuuuucagacucagcccgcucgcaccggagugaauaaacagccuuguugcucaca

SEQ ID NO: 1395 - RNA, 4109 nt, Homo Sapiens
ggcgcaacgcugagcagcuggcgcgucccgcgcggccccaguucugcgcagcuucccgaggcuccgcaccagccgcgcuucuguccgccugcagggcauuccagaaagaugaggauauuugcugucuuuauauucaugaccuacuggcauuugcugaacgcauuuacugucacgguucccaaggaccuauaugugguagaguaugguagcaauaugacaauugaaugcaaauucccaguagaaaaacaauuagaccuggcugcacuaauugucuauugggaaauggaggauaagaacauuauucaauuugugcauggagaggaagaccugaagguucagcauaguagcuacagacagagggcccggcuguugaaggaccagcucucccugggaaaugcugcacuucagaucacagaugugaaauugcaggaugcagggguguaccgcugcaugaucagcuaugguggugccgacuacaagcgaauuacugugaaagucaaugccccauacaacaaaaucaaccaaagaauuuugguuguggauccagucaccucugaacaugaacugacaugucaggcugagggcuaccccaaggccgaagucaucuggacaagcagugaccaucaaguccugagugguaagaccaccaccaccaauuccaagagagaggagaagcuuuucaaugugaccagcacacugagaaucaacacaacaacuaaugagauuuucuacugcacuuuuaggagauuagauccugaggaaaaccauacagcugaauuggucaucccagguaauauucugaauguguccauuaaaauaugucuaacacuguccccuagcaccuagcaugaugucugccuaucauagucauucagugauuguugaauaaaugaaugaaugaauaacaaacuaccucuggcacauccuccaaaugaaaggacucacuugguaauucugggagccaucuuauuaugccuugguguagcacugacauucaucuuccguuuaagaaaagguaguauuuccuuaauugcaguggucuccacugggggugaggaaggggugagaauuggaucauggcugcaaggaaacccgacuuaaccucugcaagguggugcaaaggcauuccacuguucaacagcaauuauauugaagcugagugggaucacugggugaagaugaagcguaaggggugaggggcaggagaauggguauggauggagguagaagaugcagugucauacaguuuuuuucuaucaugaaaauaaccacagacuuacagaagagaaagagcuaaaaugcccgucauuuucaguugcauggagaaugauggaugugaaaaaauguggcauccaagauacaaacucaaagaagcaaagugauacacauuuggaggagacguaauccagcauuggaacuucugaucuucaagcagggauucucaaccugugguuuagggguucaucggggcugagcgugacaagaggaaggaaugggcccgugggaugcaggcaaugugggacuuaaaaggcccaagcacugaaaauggaaccuggcgaaagcagaggaggagaaugaagaaagauggagucaaacagggagccuggagggagaccuugauacuuucaaaugccugaggggcucaucgacgccugugacagggagaaaggauacuucugaacaaggagccuccaagcaaaucauccauugcucauccuaggaagacggguugagaaucccuaauuugagggucaguuccugcagaagugcccuuugccuccacucaaugccucaauuuguuuucugcaugacugagagucucaguguuggaacgggacaguauuuauguaugaguuuuuccuauuuauuuugagucugugaggucuucuugucaugugagugugguugugaaugauuucuuuugaagauauauuguaguagauguuacaauuuugucgccaaacuaaacuugcugcuuaaugauuugcucacaucuaguaaaacauggaguauuuguaaggugcuuggucuccucuauaacuacaaguauacauuggaagcauaaagaucaaaccguugguugcauaggaugucaccuuuauuuaacccauuaauacucugguugaccuaaucuuauucucagaccucaagugucugugcaguaucuguuccauuuaaauaucagcuuuacaauuaugugguagccuacacacauaaucucauuucaucgcuguaaccacccuguugugauaaccacuauuauuuuacccaucguacagcugaggaagcaaacagauuaaguaacuugcccaaaccaguaaauagcagaccucagacugccacccacuguccuuuuauaauacaauuuacagcuauauuuuacuuuaagcaauucuuuuauucaaaaaccauuuauuaagugcccuugcaauaucaaucgcugugccaggcauugaaucuacagaugugagcaagacaaaguaccuguccucaaggagcucauaguauaaugaggagauuaacaagaaaauguauuauuacaauuuaguccagugucauagcauaaggaugaugcgaggggaaaacccgagcaguguugccaagaggaggaaauaggccaauguggucugggacgguuggauauacuuaaacaucuuaauaaucagaguaauuuucauuuacaaagagaggucgguacuuaaaauaacccugaaaaauaacacuggaauuccuuuucuagcauuauauuuauuccugauuugccuuugccauauaaucuaaugcuuguuuauauagugucugguauuguuuaacaguucugucuuuucuauuuaaaugccacuaaauuuuaaauucauaccuuuccaugauucaaaauucaaaagaucccaugggagaugguuggaaaaucuccacuucauccuccaagccauucaaguuuccuuuccagaagcaacugcuacugccuuucauucauauguucuucuaaagauagucuacauuuggaaauguauguuaaaagcacguauuuuuaaaauuuuuuuccuaaauaguaacacauuguaugucugcuguguacuuugcuauuuuuauuuauuuuaguguuucuuauauagcagauggaaugaauuugaaguucccagggcugaggauccaugccuucuuuguuucuaaguuaucuuucccauagcuuuucauuaucuuucauaugauccaguauauguuaaauauguccuacauauacauuuagacaaccaccauuuguuaaguauuugcucuaggacagaguuuggauuuguuuauguuugcucaaaaggagacccaugggcucuccagggugcacugagucaaucuaguccuaaaaagcaaucuuauuauuaacucuguaugacagaaucaugucuggaacuuuuguuuucugcuuucugucaaguauaaacuucacuuugaugcuguacuugcaaaaucacauuuucuuucuggaaauuccggcaguguaccuugacugcuagcuacccugugccagaaaagccucauucguugugcuugaacccuugaaugccaccagcugucaucacuacacagcccuccuaagaggcuuccuggagguuucgagauucagaugcccugggagaucccagaguuuccuuucccucuuggccauauucuggugucaaugacaaggaguaccuuggcuuugccacaugucaaggcugaagaaacagugucuccaacagagcuccuuguguuaucuguuuguacaugugcauuuguacaguaauuggugugacaguguucuuugugugaauuacaggcaagaauuguggcugagcaaggcacauagucuacucagucuauuccuaaguccuaacuccuccuugugguguuggauuuguaaggcacuuuaucccuuuugucucauguuucaucguaaauggcauaggcagagaugauaccuaauucugcauuugauugucacuuuuuguaccugcauuaauuuaauaaaauauucuuauuuauuuuguuacuugguacaccagcauguccauuuucuuguuuauuuuguguuuaauaaaauguucaguuuaacaucccaguggagaaaguua

SEQ ID NO: 1396 - RNA, 1069 nt, Homo Sapiens
agcaggacaaacaggccagguggugucaggagcccaggucuccagcuggagggaacgucaacccugcagugggagcaggggcccaucgcacauccuaggcacagaugcuaauguaggcacugcagaccauaaaggagaacagcaagaggcccccagcaaacauccacagauggcccuggacaucagccacauucugagaaacaugucauguucugggagggcuaaggcaucaaccuuacccuguaggaauucuagugacuauguugccaccaucuuggagcuccaugcccucauaguguaauggcaccagcagaucugccugugcauggacuuccuguacuaccucacuccugaggggagauguuucugcagggccuaugaccuggugcacaacuuuagacaccaucauccuggagcagcacugcacccucacuagccagaguguugacauccucaaggccagggccacauucaagacuuuggacuucauugaugcacuugugcugagcaagcuuaucugaucuccugggaucucuacuaggaugcuggcagcccagccagcuggucuggcccuggacgugccuucaggugcugguuaugcuuuaugaccuguguuguggugagugauaagcagcaccugcuucuagcuucacuuuugggccagauuucauccccaccgugguucuucauugcagcugcuuucugcucccucuauggacccugcauggaauugccccauguuucuguuugggcaccacugaggaaggaagcaugaaggaugcacagauccuggucagaguaaaacauuccaugggaacucgggcugugagaaacauccuaaccaccugacugcagaaacauccuuaucacauccugcugggcaagggcccaacagccugacuucaggaacauccuuaucaucuucuacugagcagcaagcuauacuguccagagcccucccucccagccccaugauuaccccagccuguaaguggcagugggcgcugacacuaagcugguuucccccuccgcaggguuuugcuaguaauaaaccuguguugcuguugaa

SEQ ID NO: 1397 - RNA, 3798 nt, Homo Sapiens
gugugauagcaguggugauauuuauuuugcuuugcaucacugccauagccauacgcaucuaucaacagagaaaguuacgcaaagaaaaugagucaaaagucucaaaaaaagaagagugcuaggacagcucuaaacagugagcuugaugugcaaaacgcaguccaugaaaaccagaaagagcgagucuucugauuggcagcuguggcugucucuaucaucgugacuguggacuucccugcuguugccaucagggugcacacagcaggugcagugcugucaccuggcugaagaccugcagccucggagccucugggaggucccuuucucccuuggugaaacacaguccuccacaucaauuuccaaacaaugaauuagguauggccauucaucacuguucaguaguuuccccguccaaaggcucucuuccaaaacugaaguuugaucuguguuaauaauugugggguuuuagaugagaaaaugacuauaaagcuguggcccuacuuuauuuuuuaaaaaugacagaacuuuuguucagauguaaaagacaaaauuacacuuuaauguuuuuuguuacuugaaaacauaucugggaucccuuuuuuugguccucugcugauauuuauaaaacaagaaaugcuucuuggacuaccuucacuggcauuuccauaguccuggaauccagagccaaguggccuaucuaaaauucacagcccuuuuauucuccugugugaugguuaauacaacacaguugaagccuggaaacacuaccauuauuuuugguguauugcuuuuucuaauugacuguuuuuaaugauuuugauacauuuuaauguugaaauuaauauugaauguuagcuaugaaauuuuaguauugaauuuuauaauggaacagaacauugguagguaacaagaugcaagaggaugucaauacaagauugucugccuguuuuucuuuguaauuuguaauuacaguuuuuguaacuugugauuauguuuuuaacuaaauuuaccaccagauacaaacacuacuucuuacacagaguuauccuuuauuuauaucauuaagacgugaaugaaacaucauccuaacuuacuuccccaagauauugagaggucauaucuguuuuucuuuaucauucauuucuuuuucuaaaaguuguuacugauaugcuuuugauuuccuaugacucuauuauguuguacagaacaucuuuucaauuuauuaaaaaaauagcuuaacugaagaucacuaauuccuuuucuaaauuuugaacugcucuaggcauaaauaucauuguguauuauccuuucaucuaaucacuuuuggaauguaaacugaaggcuguucacuccaaguuaaguuagcauuuacaugauguuuauuaaaucugccagucugaucaaagguuuaugaccauggggccaaauucccauagauuacccaaaauugaauaugugcaguuaacuggaacaugucucauuaagguuuacauacacacuaagacagcaaaggauuggaauuaacuuuauggagacaguuccagggacuaauauugaagcagugguuauuugauaaugcauggaaccaccauuuggauucaauaaaccaauuacauaaaagcaaugaugcuacgcucuucauauuccagauaccaacugccuaccaaggacuaaugagaugguauauuucuuccacaucagggcaagcugagaauauauugauucagcguuacuguuacguaaaugaauuuccaucuucucauauguguuauuuuugaaagaaugaauacacucugucuuaaauccgcucuuaacaaaugaucucuucucagaauacuacaucuguauugagaguacagacagcccauuggucacugcaccuuuugcaagacagcgaaacagaugcaucaaauugcauugauacaucaucaccaucaaucuuuugcacugauuuuuagacuuaaucuucuuauuugaaaauaaacucauuuuuaaauaaaauaaaaaauauuuuagggaaagcucuauaaaauuaaaauuacagaauuauaugcuuuuuaaaauuuaugcaaaaaugugcagacaaauguauucuguauugguuuauguaucacuuugcccuuguauauuuugagauuauuaagauuuguugacuuuuuugguuugauauuuaucaucuguuaaauuuuuccuuuuaaauuauuaaaugcaaagugcaagaaaaagagauaaauauuuacugauugcuagauguaaaaauaucuaugaauauauauauuuaaacuucugccagagagcaaccaucugacagucaacuuacuaaaaucuaaauugaguacuuuuuacuguugcagagaauuaagucacuaaacguuauuuagauauauagaugcuaguugcaaguaacacccuuuuguaauauaaaaguaaaagcauaauaauuucccaacuuuugucuucaaauuaaaaaagaaaauagcauauaauuaccauucuucauuugagaaagcugaagauucugaugcuuaaaaacuucagaauucuaauauuaaaaauagagugguucaugugacauugaaggcuuaucucuguaaaauagugacacuggugagugguauuaucucaauauuuuuguccaaauucaccuuaggaaaucacuguaaaucuucauuguuuccuaaaagucauuauuacggcauaaacuuaacauacuuugauaguaguuaguacugauacgugacauauucuaccccgugucucuauuacucugucucuauuacugugaaaagucacaguaaauuuaacauuuucuuccagacuguguaugaucuuucauuguaauagagacauggaguaggauaagucauguauuaacauguaagauuuuuuuaaccugcucccucaguuuuauagaugagacaaagauaagguuguaagagcuaaucucuucaaguaggcaguacuaguaaguugucaugcguggacugaacuccuggcacuucucucucuuaacuucaauccauagagaagcccaccuuccugccuucccaguauuauuuagcagaggagaaaaucauauuaggcuguuugauacucuguuugccuagacugaccaauaauucuggaucuuuguucacaucuucucugaaagaauauuugaugggaaaucuuuuuuauuuuuuaauuuuuguguacauacuagguguauauauuuauggaguacaugaaauguuuugauacaggcaugcacugugaaauaagcacaucauggagaaugggguauccauccccucaacauuuauccuuuguguuacaaacaaccugauuacacucuguauuuuaaaauaugcaguuaaguuuuuauugacuauagucacccuauugugcuaucauauaguaaguuuuacucauucuuucuacuuuuuuuguacccauuaaccuauccccaccucugccccaccauuaucucagcugucuacuacuuuuuucagccuuuacuaaccauccuucuacucuauauccaugaguuccguuguuuugauuuuuagaucccacaaauaaaugagaacauggcaauguuugucuuucuaugccuggccuauuucacuuaacauagugaccuccaguuccauccaugcugucgcaagugacaggaucucauucucuuuuauggcugaagaguacuccauuuuguaugugaaccacauuuucuucauucaucuguugaugaacacuuaggguguuuccaaaucuuagcuguuauaaacaguauugcaacaaauaaaagagugcagaugg

SEQ ID NO: 1398 - RNA, 2579 nt, Homo Sapiens
auguaauuacaagugugcuccugguggucuuuaacugaagggcacugacuggguacuggugaaguuccccgcaggaacugagucagaccccaucucagggcccugcagaagauaggugccugcucuaaggcguggacccucgcgacagcccuggcccgucuugacgggcgaggguuacuguacuugucccaaccguacagaugagaaagcucagacucagggccagcaaccccggucccagcggagcgcccggcacgcgccgacacuucagcaccagucgcgguggccaccacugugcgcggagauggcugcgacgcgugcgcagucuagugcuuuuuuccagaucucgaucccaaacucccuccugccagaaucuggacccgaauccacccauugcccauuuuccgcugccgcuggagagaaucucugagguccccaggacagccugccugcacggaagagaugccuccucaguauggccgcccccggagaggagcgauuaagugcagaccuccauguugcucuugagccugaguggcuucagggagccauguuuguuacuggcgggcgccggccucacugagcaugugcagcccuggccgggcggccucaaaguucugacaucacagggcgguuccugaaguggacguaguuguaagagcuaguuauuuuagacaaugccucugggaucagggacucuaaucuggaaauagguagugggagaggucggugaugcugucucggggucagagaccugagcuauaugggguuagagaggggcccugggcaggcgagucucuggggaguguggugagaauccuuguguaagaugcugggaggagguggggucagggcugggguccgugggccgauggguugggggauggccagcgucagggaucaguaguagagauucuaugugcccugaucgccaguagagguuuuaaauacagaguauucaugaguuuagcaauguuauucgccucucauaauuuaaauaauuugaaguuuucccccaguaacuagugucuuagaagucaugaaaauuucagaaaaugacaggucuucugaguucgugaugggaguugggcagcagucgcauacgagcaccuggagaguccuugccaguucuuuggggauggggagcucuuaagacugcccugagaccgcccuuugaccucauugugguccuuucuagauuaaaugcuguuuuccaugaccgucucuguucuucccauacgcgaauggcaggcauccagaucuccaagaauagaggauuaggagagacuccaccaccuauguccucacaguuaauuaucgauuugugucacuugcccauuuucucacuuccuguuugugugucaaggaguauuaauaaaucuuugccuauuuaaagauacuagccuuggauuuucaaauauugcauauuuugacauguaaaaauguguuaguuuuauuuuuucaaccgaucugaccuguauaguugggcuugaggaagcuuccucauuguacauguuacuauggauuuuuuaauauuaacacagaguuguauuuuuuccauauaaauuucuauugaauuucuuuuuccauaugauagguggugaagguuuagcccaguaaagcagagagguuaagagguuagacugggggcucuggagccagaccuauguagaucugaguccuggcucuggcacuugaaagccgugugaccuugguuaagauacuuagccccucucugccaaauggagaaauaagggcaccuaccccguaggguaguugugugaguacacaaguuaauacacuucaaucacuagcaagaaagugaaugucaagcuguauuuguucaggcagccauaugguagccccaccucauuaguaaacugagguauugaaguaucuucuuuuucuuucagaaaauauuugucaagcaccuucuguguucuaagaacuguucuagagcuuugcaugcuauggaggucuagaaauucacauuaugguggcaggugacagacaauacaaagagauaaagcaauuucauauagugauaaccuagggaggcgugcuaaaaggagccaagguguaguggugacuggaaggugaccagggaaaccacuguaggguuucuaacugaugagaucugugacaaaucccuguggucagcagcaggcauuggauauguaacuuuauucugucccauugaucuuguagucaacccuggucuguucuguauuguuuuaauuacauaaucuuuguaauaaucuuuaauaccugguggagugcucuguuuacuuauuucugcauaauuaaccaccccuaagcuuaacuuacucaugguucugcaggaugacugcucuccaugguuauagggguuucugcauggggccucucacaugugcuacagucaaacauuagccggggccacagucaucugaaacucacuuacacggcugacaauugauguuggcuguugccuggagaagacauauguggccugguggaauggaauggugacuagauucaagaaagagcuucccaggagcaaggcuaccaagagaccgaaguagaggcuucaguuucuu

SEQ ID NO: 1399 - RNA, 391 nt, Homo Sapiens
guaagcgcaggggauuguccagacagccaggaggccagcgaagccaaguccuucaguacagccugggagccuccaggaagcuguuaggaguugccaugaugggugcauuuggacucacagaaucugccuuccaaucucagugcugcuucuacuccuuugcuaccuuaggucuuugaagacagguccauaccuuggguguuuguauuuggacaaccacagacauugccaagaaauguaucuguucuacuugcacaccuucaccaccuggaugcugcuugaggacacagaucugguccaucagauuucucucuguacuccucucuauauuucgccauauuugauauagacccaucaauggcucccuagaauaaaaucucaacucuucacugug

SEQ ID NO: 1400 - RNA, 1647 nt, Homo Sapiens
gucaccaccccauccccagggaugggcggaggggguggcggcagcgacagcaggggaggcagcuggauuaaacaggucaccugcagguauuuuaugcugggguuuguaaggaaggugauaacugucgcuacucccaugaccucucugacaguccgugugguguagugugcaaguauuuucagugaggguacuguauuuauggagaccgcugcagauaugaacauagcaagccauugaaacaggaagaagcagcugcuacagagcuaacuacaauaucaucccuugcugcuuccucaagucucuugucguuagucggaccacuuguugaaaugaauacaggugaagcugagucaagaaauucaaacuuugcaauuguaggagcagguucagaggacugggugcaugcuauugaguuuguuccugggcaacccuacuuuggcuauauuagauuuucaguucccuuguaguucauguaucugucuuauuaguuuggaccuuuaccacccucuugaaaauuuucagcugugccuuccugcacugaagcaccucugcaggacucagugaccaaggaagaaucagagaaagagaaaaacugcuguggaaaccaagaagcagcugugccccugugcugcagugagagagugcugagauggggagaacugugugccucuccauggagauucaugugacauguguggacugcagguccugcaucccauggcugcugcccagagaucacagcauauaaaauugugcauugaggcccaugagaaggacauggagcucucacuugcugugcagcgcagcaaggacgugguguaugggaucugcauggagguggucuaugagaaagcaaaccccagugagugcugcuucgggauucucuccaacugcaaccaugccuacugucucaagugcauucgcaaguggagcagugcuaagcaauuucagagcaagauuauaaaguccugccuagauugccagaucacaucuaacuuugucauuccaagugaguccuggguggagaaagaagagaagcagaaacucauucagaaauacaaggaggcauugagcaacaaggcuugcagguauuuugaugaaggacgugggagcugcccauuuggaaggaauuguuuuuacaagcaugcguacccugauggccuuacagagaagccacagagacagaaagugggaacaucaagcagaaacuggguccaaugaaggaaccacuucugagaacucacugaggaaagagauagcagcaacccuuuugacaaugaugaagagguugucaccucuugaggugggcgagauguugcuuaugcuuuuggcugcagguggggaugaugaacuggcagacucugaagaugagugggacuuguuucaugaugagcuggaagauuuuuaugauuuggaucuauagcaaccuuguguggcgugugaacuggucugcugaccccagacagcagcuguccccugugcugguguggcagugccuguguucucuccuagguaggccuaucaacuccagguguuguaaaaauuuuuacccagggccugucuucucaacccuucaccuuuccccgaggaguguguuauuuucccuguugaaaacaguuaaaacuuaaaguuaguuuuuuguaacac

SEQ ID NO: 1401 - RNA, 1107 nt, Homo Sapiens
ucaaacacaauaucggaagcaaauuuguauugaaaauuuguagauguacagauuuacagauuuugauguaucaaacauuucaauuuaccugaaucauguccuuuucuauacuacccagcaggcaggugaccuagaacacauggagacaagaaauuacucugccaugacugaauucuuucugguggggcuuucccaauauccagagcuccagcuuuuucuguuccugcucugccucaucauguacaugauaauccuccugggaaauagccuccucauuaucaucaccaucuuggauucucgccuccauacucccauguauuucuuucuuggaaaccucucauucuuggacaucuguuacacauccucauccauuccuccaaugcuuauuauauuuaugucugagagaaaauccaucuccuucauuggcugugcucugcagaugguugugucccuuggcuugggcuccacugaguguguccuccuggcugugauggccuaugaccacuauguggccaucugcaacccacugagguacuccaucaucaugaacggagugcuguaugugcaaauggcugcaugguccuggaucauaggcugucugaccucccuauugcaaacaguucugacaaugauguugccuuucugugggaauaaugucauugaucauauuaccugugaaauuuuggcccuucuaaaacuuguuuguucagauaucaccaucaaugugcuuaucaugacagugacaaauauuguuucacuggugauucuucuacuguuaauuuucaucuccuauguguuuauucucucuuccauccugagaauuaauugugcugagggaagaaagaaagccuucucuaccuguucagcgcacucgauuguggucaucuuauucuacgguucagcccuuuuuauguacaugaaacccaagucaaagaacacuaauacaucugaugagauuauugggcugucuuauggagugguaagcccaauguuaaaucccaucaucuauagccucaggaauaaagaggucaaagaggcuguaaagaaaguccugagcagacaucugcauuuauugaaaaugugaaaaaccuugggcaugcgauaucc

SEQ ID NO: 1402 - RNA, 4689 nt, Homo Sapiens
cuauuguuucuaccucacccuggcccaggaagacagaucuacugaggaaagcccugaacacucugcggcuucucugagaaacccuaucgaaggggauguggaaucccagagcuacucuugcuaucaacucgccgcaugaccuugggaaaaucauuucaccugguucagcaaugauuuacugagcuauugaaggccuuacuuuccagauccaguucgacuccuuccugcaccccugcagcuggaagaggaggcuuggagaugguagaaacauaagauggaaggggucuagauggcuggaugacugcuugaggagaguuauucaagacugcuacuuagcugaugucagacucugaauccuugugcauacaacugacuugugugggugaggcuugcagaaaaaaucagcuagaacagccuuggggguaguggcaagguggccagagcaauugacugggagcugggaacaggaaugaagaggaagagcugauaagaaacaugcccagagcagauuugaugcuacugccaauguaccugaauaagaagacaacucuuucuggaaaaagggaaaacuugaagggcuauugaaggccgcuagaaaggaaggcugagagagguggcaaagcugcagaagaaaaguuugaagcuagcagagauugguucaugagguuuaaagaaagaagccaucuuuauaucacaaaaguucaagguaaagcagaaaauauugauauagaagcugcaacaaguuauccagaagaucuagcuaagauaauugaugaagguggcuauaauaaacaauagauuuagaguguagacaaaacagcuuuauauuggaagaagaugccaucuaggacuuucauagcuacagagaaguuaaugccuggcuucaaagccucaaagaauaugcugacucuuguuaugggcuaaugcagcuguugacuuuaaguuaaagccaauguucauauaccauuccuaaaaauccuaagauuuaugcuaaaugacucugccugugcucuauaaauggaagaacaaagccuggaugacugcacgucuguuuacauaaugcuucacugaagauuuuaagcccacuguugagacccacugcucagaaacaaagauuucuuucacaguauuacugcuuauagaccauucaccuggucacccaagaguucugauaauauacaagaagauuaaccuuacuuuuaugcccuacgaacacaauauucauucugcagcucaugguucaagaaguaauuuugacuuucacauuucauuacugaaaaaaauacauuuuguaaggcuguaacugccauagaaagugauucuucugaugaaucugagcaaaguaaauaaaaaaccuggaaagaauucaccauucuagaugucacuaggagcauuugugauucaugggaggauaucaaaaugacaacauuagcagaacuuuggaagaaguugauuccaacucucacauauaaauaacuuuguucaagacgucagugguggaaguaacugcagagguggcuuaaauaggaagaacacuagaauuagaaguggauucugaaggcauggcugaauugcugcugucucaugauaaaacuugaaugaaaaggaguugcuuuuauggaugagcaaagagugguugcuugagagggaaucuacucuuugugaggaugcugugaacauugcugaaauggcaacaaaugauuuaaaauauugcauaaauuuaguucaucaaacagcaucagguuugaaagaauugucuccaauuuugaaggaaguuauacugugagcaauaugcuaucaaacagcaucacaugccaaagagaaauauuuugugaaaggaagagucaaucaacauagcaaacuucauuguuaucuuaaguaauuuccauagccaccaaaccuucagcaaccaccacccucaccagucagcagccaucaauacuggggcagaaucuccacuggcaaaaagauuaggacuugcugaaggcuuagaugaccauuagcauuuuuaaacaagaaagcauuuuuuuaguuaagcuaugugcauuuuuagauuugaaagacauuucucaaaagaagacauacaaguggcaagcaggcauaugaaaagaugcuacacaucauccaucaucagauaaaugcaaaucaaaacuacaaggagauaucaucucacaccaguuagaauggcuuauauccaaaacacaggcaauaacaaaugcugaugaggaaguggagaaaagaggacagucaaugggaauguaaauuagcacaacuauggaguacaguuuagagguuucacaaaaaacuaaaaaugagcuaccauaugauccagcaaucccacugaugaguauauauugaaaagaagguauaucaguauauugaagagauaucugcacucuuauguuuguugcagcacuguuuacagcaacuaagauuuggaagcaaccuaaguguucaacagaugaaugguuaaagaaaaugcgguacauacagacaauggaguacuacucagccauaaaaaaaaugauauccagucauuugcagcaacguggauggaacuggagaccauuauguuaagugaaauaaaccaggcacagaaagacaaacaucgcauguucucccuuauuugugggauccaaacaacaaaacaauugaacucaugcucauagagaggagaaggaugguuaccagaggcugggaaagguagugggaagguggaaagggagguggggaucgguaauguauaaaaaaauacuggaaagagugaauaagaccuacuauuugauaguacaauggaugauuauagucaauaauaaccuaauuguauauuuucaaauaacauaaagaguguaauuggauuguuuguaaauggaguuucacucuugucgcccaggauggaguacaauggcaugaucuuggcucacugcaaccucugcuuccaggguucaagugauucuccugccucagccuccugaguaggugggcuuauaggugcccgccaugaugcccagcuaauuuuuguuucauuaguacaaauaggguuucacuaugucggccaggcuugucucgaauuccugaccucaggugaucugcccgccucggccucccaaagugcugggauuacaggugugaaccaccgugcccgguuugaguaaccuuuaaguaagaaagugccuuuuggguugaguuuaacaauuuccaugguagagagucucuucugcuauaugcuguuuacuuagcuucugccuaguauaugcagcagcagaaaaugguuucccuuguuguaggucuaaugagauuuagaacacuuuggguccucagauauagugagcaagauuuucacuucauagaugaaggaacugcagccuaaagaauugggaagaaaagguuuauccaggcuugcugugcauuccuuccuuucucugggaauucccuuggagaagaaaucuggcugaucaaaucuccuuguaaacaugcugugaagacucuggggaaaaccacuaaugauauuuguuaguggcagucuuuaucuuugagagacuuuuagcagcaugaaccuuacccccguaguagaauuguauaugguaaacaaaccuggaaucuaaggauucauggguaauggcuucuugaaaagugucaaguaagcuauguaacuauggcaggagauggaacuacuucaggguuaaaaaagcuggcuuucauuucgugcaaguaauguacuuguguacaucuuuuggagaaccauauguuaaauccgaaucagaccaaguccuaaugugguaagaaaagggcuguggaguaguauuggcaguccugggcuuuucccuauguucccuguaccuugugauuacuuauagcuuugacauuauuaguaaaguuugauacuugguaaaauauacagaaggaacuuuggaugugggagagaaagacaaggagaaaccugaaagcagcccaguuaugacaaugaauguucuggaggcugggaaguggaagagcauugugccagcaccuggugagggccuucuugccguguuacacaugaugguuuuuacugaugcccugcacagagagaggucuguaaaguggcaagcaggagucugcuacaauggaggaaaggauuuugcuguaucucuugccaggcccaaggcugcagagggaauugcagauugaauguaagugacuuggaaaaggaagaggaguugccagaaacagcuaaaaugucaguagaagacuugacagcuugagaauagaggaaaaaauaaaagcgaagcagacaaaaagaaccuuaccucccccacaauacaacauugggcugcugaacccacaaaaaucuaaauccguuuagaaucaucuauuuaacuccucagagacaugcacaaacuauucuagagaggcuugugccuacgaagauuacuuaagaauguguugacacauuuggaggggguuaauuuaccaguuaucauuuacuagaaaggcuuuuucuauaagaauauaugaaagaguuuccucggagcauucaaccgggcuucuuuguaggguauguguacugcuuggagcuacggaagaccacguccuagaagugcugugucccugaggcacaccuauguguguuaucucucuggcauacuuuccaacaaggauucuuuucuagucuauacauucugauuaauuugcagucagaggcaaugc

SEQ ID NO: 1403 - RNA, 110 nt, Homo Sapiens
agaagggcuaucaggccagccuucagaggacuccaaggaacauucaacgcugucggugaguuugggauuugaaaaaaccacugaccguugacuguaccuugggguccuua

SEQ ID NO: 1404 - RNA, 1215 nt, Homo Sapiens
cuuugggccucaucauuuacaaaagaagcuugggccccugacagcaugcaucuccucuuauuucagcugcugguacuccugccucuaggaaagaccacacggcaccaggauggccgccagaaucagaguucucuuucccccguacuccugccaaggaaucaaagagagcuucccacaggcaaccaugaggaagcugaggagaagccagaucuguuugucgcagugccacaccuuguagccaccagcccugcaggggaaggccagaggcagagagagaagaugcuguccagauuuggcagguucuggaagaagccugagagagaaaugcauccauccagggacucagauagugagcccuucccaccugggacccagucccucauccagccgauagauggaaugaaaauggagaaaucuccucuucgggaagaagccaagaaauucuggcaccacuucauguucagaaaaacuccggcuucucagggggucaucuugcccaucaaaagccaugaaguacauugggagaccugcaggacagugcccuucagccagacuauaacccacgaaggcugugaaaaaguaguuguucagaacaaccuuugcuuugggaaaugcgggucuguucauuuuccuggagccgcgcagcacucccauaccuccugcucucacuguuugccugccaaguucaccacgaugcacuugccacugaacugcacugaacuuuccuccgugaucaagguggugaugcugguggaggagugccagugcaaggugaagacggagcaugaagauggacacauccuacaugcuggcucccaggauuccuuuaucccaggaguuucagcuugaagagcuaucccacuauuaccuuugaaaagcaaaaccacaacagcaaagaugcugauuauucagucugaaaauguuaaguggguacauaacauuuucagggaaaggugacuugaaacguaguuuuaaauuagaacgauagaggaaaugauauuagucuaguuauugguacacguuugagaccuugucucagcucugccacuaacuagccguagaauguuaaguuguaaaaccuuucuccaucuaaagauuuucaucuauaaaugacggacccgaccuagaugauugcuaaaauccuuuccacuacuaauauuccgugaugcauuuucuccaaguuuggguaaaagcccuccaucuaaagaaggaaaa

SEQ ID NO: 1405 - RNA, 737 nt, Homo Sapiens
uacccaccucagguagccuagugauauuugcaaaaucccaauggcccgguccuuuucuuuacugauggucgugcugguacucagcuacaaauccaucugcucucugggcugugaucugccucagacccacagccugcguaauaggagggccuugauacuccuggcacaaaugggaagaaucucuccuuucuccugcuugaaggacagacaugaauucagauucccagaggaggaguuugauggccaccaguuccagaagacucaagccaucucuguccuccaugagaugauccagcagaccuucaaucucuucagcacagaggacucaucugcugcuugggaacagagccuccuagaaaaauuuuccacugaacuuuaccagcaacugaaugaccuggaagcaugugugauacaggagguugggguggaagagacuccccugaugaaugaggacuucauccuggcugugaggaaauacuuccaaagaaucacucuuuaucuaauggagaagaaauacagcccuugugccugggagguugucagagcagaaaucaugagauccuucucuuuuucaacaaacuugaaaaaaggauuaaggaggaaggauugaaaacugguucaucauggaaaugauucucauugacuaaugcaucaucucacacuuucaugaguucuuccauuucaaagacucacuucuauaaccaccacaaguugaaucaaaauuuccaaauguuuuc

SEQ ID NO: 1406 - RNA, 939 nt, Homo Sapiens
aucccaauggcccuguccuuuucuuuacugauggccgugcuggugcucagcuacaaauccaucuguucucugggcugugaucugccucagacucacagccuggguaauaggagggccuugauacuccuggcacaaaugggaagaaucucucauuucuccugccugaaggacagauaugauuucggauucccccaggagguguuugauggcaaccaguuccagaaggcucaagccaucucugccuuccaugagaugauccagcagaccuucaaucucuucagcacaaaggauucaucugcugcuugggaugagacccuccuagacaaauucuacauugaacuuuuccagcaacugaaugaccuagaagccugugugacacaggagguugggguggaagagauugcccugaugaaugaggacuccauccuggcugugaggaaauacuuucaaagaaucacucuuuaucugauggggaagaaauacagcccuugugccugggagguugucagagcagaaaucaugagauccuucucuuuuucaacaaacuugcaaaaaggauuaagaaggaaggauugaaaacucauucaacauggaaaugauccucauugauuaauacaucaucucacacuuucaugaguucuuccauuucaaagacucacuucuauaaccaccacaaguugaaucaaaauuuucaaauguuuucaggaguguaaagaagcaucguguuuaccugugcaggcacuaguccuuuacagaugaccaugcugaugucucuauucaucuauuuauuuaaauauuuauuuauuuaacuauuuuuaagguuuaaaucauguuuuauguaauaucauguguaccuuuacauuuugcuuaauguaacaauauauguucuucauauuuaguuaauauauuaacuuccuuuucauuaaauuuuuacuauac

SEQ ID NO: 1407 - RNA, 778 nt, Homo Sapiens
guuaccccucaucaaccagcccagcagcaucuucgggauucccaauggcauugcccuuugcuuuaaugauggcccugguggugcucagcugcaagucaagcugcucucugggcuguaaucugucucaaacccacagccugaauaacaggaggacuuugaugcucauggcacaaaugaggagaaucucuccuuucuccugccugaaggacagacaugacuuugaauuuccccaggaggaauuugauggcaaccaguuccagaaagcucaagccaucucuguccuccaugagaugaugcagcagaccuucaaucucuucagcacaaagaacucaucugcugcuugggaugagacccuccuagaaaaauucuacauugaacuuuuccagcaaaugaaugaccuggaagccugugugauacaggagguugggguggaagagacuccccugaugaaugaggacuccauccuggcugugaagaaauacuuccaaagaaucacucuuuaucugauggagaagaaauacagcccuugugccugggagguugucagagcagaaaucaugagaucccucucuuuuucaacaaacuugcaaaaaagauuaaggaggaaggauugaaaacugguucaucauggaaaugauucucauugacuaauacaucaucucacacuuucaugaguucuuccauuucaaagacucacuucuccuauaaccaccacaaguugaaucaaaauuuucaaauguuuucaggaguguaaagaagcaucauguauaccugugca

SEQ ID NO: 1408 - RNA, 7731 nt, Homo Sapiens
ggcuuccggagucccggcuggcgcugaguuguaggcgcgcgccuaacuggcaucgcggggacucacucggucugagaguucggagcgcugagguucaggcgcgcgccuaacggcuuagcugggcucacucggucugagaggucggagucugcgagugucgcugcugaaggcugugguggaccgggcuggaucgcggauucugagcuacauugcggguuuggggguggaucuuggauuuggggguggaucgcggguugcgggggggaucgcggguugcgggggagaucgcggauuuggggcggaguggggguggaaaggccacgaggagccgccgcggcucaggagcggguggugggcgucugagaagucgccaccaugaggaagcucuucagcuucgggagacgccugggccaggcgcuccugagcuccauggaccaagaguaugcggguccggguuacgacauucgggacugggaacugcggaagauccacagggcugccaucaagggcgacgccgcggagguggagcgcugccugacgcgcagguuccgggacuuggacgcccgcgacagaaaagacaggacuguucuacauuuggccugugcccauggccgugugcaaguggucacucucuugcugcacagaagaugccagaucgacaucugugacagacuaaacaggacaccuuuaaugaaggcuguacacagccaggaagaggcuugugccaucguucuccuggaauguggcgccaauccaaacauugaggauaucuacggcaacacugcucuccauuaugccguguauaauaaggggacuucacuggcagaaagacugcuuucccaccaugcaaauauugaagcacuaaacaaggagggaaacacuccacuuuuguuugcuauaaauuccaggagacagcauaugguggaauuuuuauugaagaaccaggcaaauauacaugccguugacaauuucaaaagaacagcccucauacuugcaguacagcauaacuugucaaguaucgucacccuccugcuucaacaaaauauacguaucucuucucaagacauguuuggccaaacugccgaggauuaugcucuuuguucugauuugagaagcauccgacaacaaauuuuggaacauaaaaauaaaaugcuuaaaaaucaucuucgaaaugacaaucaagcagaagcagcagccaugaagaaugaaaguuuuaaaacacaaggagcaaguucaaaagucucgcucuaucaccagucuggaguccaguggcaugaucucagauuacugcagccuucaccucccagguucaagcaauucuccugccucagccucccgaggagcugggacaacaggcacaugcgaccaugcccagaaacagcagcuaugaagccugcaaauuugaaaaaaagaaaagaacgugcaaaagcagaacacaaccuaaaaguggcuucagaggaaaagcaagaaaggcuccaaagaagugaaaauaaacagccacaggauucucaaaguuacggaaaaaagaaggaugcgauguauggaaauuuuauguugaagaaagacauugccaugcucaaagaggaauuauaugcaauaaaaaaugacagucucagaaaggaaaagaaauauauucaggaaauuaaaagcauuacagaaauaaaugcuaacuuugaaaagaguguaagacucaaugaaaaaaugauaacaaaaacaguggcccgguauucgcaacagcuuaaugaucugaaagcugagaaugcaaggcugaauucagaauuggagaaggaaaaacacaacaaagaaagacuagaagcugaaguugaaucccuccauucuagccuggccacugcuauaaaugaguacaaugaaauuguggaaagaaaagaccuagaacuaguuuuauggagagcagaugauguuucuagacaugaaaaaauggguucuaauauuucucaacuaacagauaagaaugaguugcuuacugaacagguccauaaagcucgggugaaguucaauaccuuaaaagguaagcuccgugagacaagagaugcucucagggaaaagacauuggcuuuaggaaguguacagcuggaccuaaggcaagcacagcaucgaauaaaggaaaugaagcagaugcauccaaauggagaagcuaaagaaagucaauccauuggaaagcagaacucuuuagaggagagaauacgucaacaagaacuugaaaaucucuugcuugaacgacaacuagaggaugcucguaaggaaggcgauaauaaagagauagucauuaauauccacagagacugucuugagaauggaaaggaagaucuucuagaagaaagaaauaaggaauuaaugaaagaauauaauuauuuaaaagaaaaacugcuucagugugaaaaagaaaaagcagaaagagaagugauugugagagaauuucaagaagaacuggucgaucaccuuaaaacauuuucaauaucagagucuccacuggaagguacaucacauugucauauuaauuugaaugagacauggacuucaaagaagaaauuauuucaaguagaaauucaaccugaagaaaaacaugaagaauucagaaaacuuuuugaauuaauaucauuacugaacuauacugcggaccaaauaagaaagaaaaaucgugaauuagaagaagaggcaacuggauauaagaaaugccuagaaaugacaauaaauauguuaaaugcauuugcaaaugaggacuucaguugccauggagacuuaaauacagaccaacugaaaauggauauucuguuuaagaagcuaaaacagaaguuuaaugaucuuguggccgagaaggaagcugugucuucagaaugugucaauuuggccaaagacaaugaaguucuucaucaggaguuauuaucuaugagaaauguacaagagaaaugugaaaaacuugagaaggauaaaaagauguuggaagaagaaguauuaaaucuuaagacacauauggaaaaagauaugguagaacuugguaaacuacaagaauauaaaucggagcuggaugaaagggcagugcaggaaauagaaaaauuagaagaaauccauuuacagaaacaagcagaauaugaaaaacaauuagagcaguuaaacaaggauaauacggcuucacuaaaaaagaaggaacucacacuuaaagauguggaauguaaauucuccaaaaugaaaacugcuuaugaagagguuacaacugaauuagaagaauuuaaggaagccuuugcaggagcagugaaagcuaacaauuccaugucaaaaaaauuaaugaaaucggauaagaaaauagcagugaucagcaccaagcucuuuacggagaaacagcggaugaaauauuuucucagcacucuuccuacaaggccagaaccagaguuaccuuguguugaaaaucuuaauaguauagaacucaacagaaaauauauucccaaaacggccauaagaauuccuacuucaaacccacagacuucaaauaacugcaagaacuucuugacugagauggagcuggaccguguagaacaaauaauuacaggaacaaagaaaaguuuugcuauguugagcacuugcucccgucuacuuucuuuuguagaauccacugguaagccacaucuaaugaagagauuaaccauaaaaucuuaaggaaaaguuguaugauuuaaaagaucauaaaacuuuauuacugggcuauuuacaugaaauuuuaauuguuucucauauaauauaaaacaucauaaucuuuacuaaaguagaauauuuucaugucacauaugguguauauuuauauguuauuuuaaaugauguuuuuuagccuccuuaaguuuuaaguggaucuugcaaaugaacaccagcguuauugaguuuggccuacucaaauugccugaaugucagcuguuuaaacagccaaacaaccaagucaucauugauacuuuaguaaaggucaucgagggcuucuuugcauuuuacaguuuuuauuaccauauguaguaggagacuuaaagaguaucugccagguuuguccauacuaguguuacgguuuucuucuuguagcucaauaguauuuuguguggagauacuuugaagcucuguaaauaucugguuacuccucaaaacccacuagauuuagcauuucauggaugacuuguguuugaacaaguauuacugugaugguugccagaugauuguuuuucuuauuuucuucuuuguucuacauggagaaauaaaaccaauaaauaaaggagaacaccaaggaagcacaggcgagcccuucccaucaugcgcucacuaguccccaacagaagaaccacugucgcauccacugagugcugggaggucagacccugugagggcugugggggcaucaggcgcagugggcuccagggagccuggccugagaccugcccagugcauugagggugcaccuggagcccacuccgccugaugcccccacagcccucgcagggucugaccucccagcaugcaccugccccucccugcaccccagauguccacccuaccuguucccugacuuccuccauccuguccagcaggaugggcuggacagugggacagccugugugcacauuuuguggcaaguaggagugacacaccaucccugggaggcaccaugguuccugccaaacccaaccccagaacucugucccugaggugguuuuaccaaaacccaaaacccagaauugugcuuguggcucaggggucagcaccugcuaguaccaggacacuacugggaggcugggaccugaccgaagcccauggugucuguggccugaggacaggguguguuggggccauaagucccggccaccaauggccauuggguccuagggccucagccccaguguuugcccuucccuggcuccuucugguucagucccauuagggcccuggagcccaagacccagcacccaagguccccuccaggaauacuggcggcuuggcuuccuuuaucauguuucaucugagagcaaaaaugucagaucggaugcacagaaaaauggcccaaauuguuuaauaacuagaagaaauauaggagcagcaagaggguaauauggagaggggagggccuccaugaccggugucugcagagccagggguacaggcacccaguguuguggccuggcaccaccggccucucagagcguggguggcccacugucuuuacccggaggacagcaggccugaucaccagcuuuucuaccugucccuguaagcaucacguugcuagaagaaaaucucaugccagagcuugcaccaucccuagcuuggggguuagggguugucucuuggugaccuaaaugaaaaaauagguccagaucagaguuccugacgcagagcacucacccacucuuugaaucgugggaggggaggccugguuuuaguuaaaccuaaccucuuugaggaaccacagagcccaagacuggaagccuucagaaucuucuggcccccaacccucccuggggaccccuguggccugucucaccagagcacucuucugucuguagaugucucagcugcucuacaagggagucccauuucagguguggggcugggcauggucacuccugcuggaugucuagaagguggaaacuaaggaccuaggaaaaugccagauacagccuuuccacccucauccagagcaggacaaacaggcccgguggugucaggagcccaggucuccagcuggagggaacgucaacccugcagugggagcaggggcccaucgcacauccuaggcacagaugcuaaugcaggcacugcagguaagcugggcuugguauccuucccuggcuucagaaagaagccaacaaggagcguuuugcagaaugaaaccuuuguuuccagaagcacugcugacuguaagugguugccguuuguggcagugagcauuuuguccauucugagguuggauugguuucuccuuuuggccuugcccugcccuacagaccauaaaggagaacagcaagaagcccccagcaaacauccacauauggcccuggacaucagccacauucugaggaacaugucauguucugggagggcuaaggcaucaaguaaggccuguggggcuggaggauccaaggcaagguggggcaauccagagccaugggggcuucccaugggaauugggaggucccaaggcagagucagagguuccacaggaggagucagagagucaccaagggcucuccuggcccagggagcagucaacaccauggacugaacacuugcugggcuccaacccuugggccaggcugcccauguggggccaggaggcagcucagagugggaggcagagagagaagugugcucagagggcaccuguaucuggauguaaugugguccugagacucuggcugggaagugcuuccaggguaucauauguguuaugcagcuacuuccucuccccagccuuacccuguaggaauucuagugacuauguugccaccaucuuggagcuccaugcccucauaguguaauggcaccagcagaucugccugugcacagacuuccuguacuaccucacuccugaggggagaugcuucugcgggccugcgaccuggugcucaacuuuagacaccaucauccuggagcggcacugcacccucacuagccaggguguugacguccucaaggccaaggccacauucaagacuuuggacuucauugaugcacuugugccgagcaagcuuaucugaucuucugggaucucuacuaggaugcuggcagcccagccagcuggucuggcccuggacgugccuucaggggcuggguaugcuucaugaccuguguuuuggugagugguaagcagcaccugcuucuagcuucacuguugggccagauuucauccccaccguggcucuucauugcggcugcuuucugcucccuccauggacccugcguggaauugccccauguuucuguuugggcaccacugaggaaggaagcaugaaggacgcacaggucaggccauucuguugcccaccucgugcugggucuuuacuccugggauggcuucaggggcagcuccuuuuccaugccuccccccacccaacaucucucagguugcugcucaaaggucaccucuuggaggggucucucccugucacuguguuuggaacagcucccucaguuucuuucuagcucaucucacucugguaaugucuuucauuaccaccaccaucugaccuggucuuacgaccuguuagcuuccuucaucagacaagagcaccaggauggcaggggccucaucuguccuguuccuccuguggccuggguccuagcaccaugucugguacaguguaggugcucaagggaaguuuacuuuauagaacugucuaccugggagagguuacuguuagucuaagcugcacuauuugguaaaccccuugcuguuuugcagauccugguuggaguaaaacauuccaugggaacucgggcugugagaaauguccuaaccaccugacugcagaaacauccuuaucacauccugcugggcaaaggcccaacagccugacuucaggaacauccuuaucaucuucuacugagcagcaagcuauacuguccagagcccucccucccagcgcuaugauuaccccagccugugagcggcagugggcacugacacuaagcugguuucccccuccgcaggguuuugcuaguaauaaaccuguguugcuguug

SEQ ID NO: 1409 - RNA, 1077 nt, Homo Sapiens
aguaagauaugguucucaaggccuggagaggcaaaccauguccagaaaaggucccugaugauagaacucccugaguauucuugcagaaaugaauauccaccaggcuucuucuuuuuuuuuuuuuuuuuugagauggagucugucucugucgcccaggcuggcgugcaauggugggaucuuggcucaaugcaagcuccgccucccagguucacgcuauucuccugccucagccucccaacuacucaggaggcugaagcaggaggauugcuugaacccaggaggcggugguugcagugagccaagguggcgccaccgcucuccagccuggcaacagagcgugacuccaucucaaaaaaagaaaaaaaaaaauuucagggauauuuauguagugaccuguuauuuaauuuuucaauaauauaaaucuguuucaagaaaaagaaauuuuaaauaaacucuuaugauuuucuuucuccugaaaauuauuccagaacuuaaaaaaaaagaagaaacaaaacagaguaaguacauuagcuuuauucaacauagcaucuugucuaguaguaaacuacuaaaaacagucuccugaguggaaaaaauauaaauuuuugucuauagcaucagcguuguccugcguguucucauuauuuucuccaaauaaauuggcucaauaugcugcuaaguauuaccauuuauguuuauuuugaaguucuauaucuugucuuuccuguuucaucuguaaacaggcaauuauugccucaguguguauucugauacauuuucucucuaaaucuauuguccaacaucuugcauauaaaaucuggcuuuucucucauauaucaaaaucacaggucacauagucucagugccaagaguuauaagaacaacuacuuuauuucacucccaucucugugaauacaaaacuucaaucucuaaaguauuuuguaucuauuuauaacacuauguuccugguuuauuauuauauuauuucauuauuaguucuuaaaaacuuaacaaggugcugaauaauuuugugaaauauuccauggagaacuaccauuaaaauagugauuacuuuaa

SEQ ID NO: 1410 - RNA, 1702 nt, Homo Sapiens
agugaggucggcgcccgccaguaacaaacauggcucccugaagccgcucaggcucaagagcaacauggaggucugcacuuaaucgcuccucuccgggggcggccauaccgaggaggcgucucuuccgugcaggcaggcucuccuggggaccucagagauucucuccagcggcagcggaaaacggacaauggguggauucggguccagauucugguaggagggaguuugggaucgagaucuggaaaaaagcacuagacuggaagaggacgcgauggagucggagccgcuggcggggacaaaaaccagaggccggggaaggcgccggugggaggcaaggcacggauggacuuuaccugcgcacgcgucgcagccaucuccgcgcacagugguggccaccgcgacuggugcugaaguguuggcgcgugccgggcgcuccgcugggacccggguugcuggcccugagucucagcuuucucaucuguacgguugggacaaguacaguaacccucgcccgucaagacgggccagggcuguggcgaggguccacgccuuagagcagguaccuaucuugugcagggcccugagauggggucugacucaguuccugcggggaacuucaccagugacccagucagugcccuucaguuaaagaccaccaggagcacacuucuuaaaaugucaaaaugaaauauugucuauuaaaacagaagaauuaaaauaaacaagagaaguugggcauuggucaucugaugguuguaaccuccagcuuucccaggaaauaugagaagacauggaaaaaaaaaaaccuuaaaugcccaucgcuaagugaaagaagccgaucugaaaagacuacauacuguuuccacagucugcagaauauaaaauaaaugucuugaauaagcuacgaagaccaaggcacuuuucggagcagauuuuuuugucuuaaaguuuuaucucaugcaaacacugcguauaacacaaacuuauauaaucaaugcuuuuagcaaaaugucauaguagaaccaaggcccaguuguuagcugaaaucuauauaaauauaggcaggaguagggcugauuggagccauuguacagugucgggaacauaccaggacacugagaauagugucaugucauaaggacccagagcagauggacccugcugugaugcacaaagaggaccacgcaagauaugauaaagaucuacaucacugaauuuugguuccauuuuuguaucucagcuuccaggaaauaaaaaagaauucuaacauucauacuuucaguauuuuaugugagagguuuuguugucaaaaucaagucugagagcaauguuuguuggggccuuuaauuggagucaccaagcgauaaaggggacauuguccucaacaauaacccuauaauaaacacguuuuggacaauaaauauaugacaauuucuuaaaagcaauuucuugggcaaucaagacaguauggcuugaguauggaguuauacgaugguuuggauuaauccaguauuaaaucuuugguuauuacagaaaucaauggagccuauucuuccaaauaauccuuaaauauuacuuaucucaacugagauuuuggugaaaauuuagcuuuagagcuuuuauugaccugccaaugaccugaaguuaagauuauucuuuucuacugaaugaagacaaacuaccuuauaaaaauuaacccaga

SEQ ID NO: 1411 - RNA, 3260 nt, Homo Sapiens
aguaggcuggagccggggucagcuuuggcaccuuccuccagucaguggccaacuccuggcucaguggggauugugcucguccccuccguuccccuccagucuuccucccgcuaccggaacgagccucgcgcuuggcaggcugaggaggagcaaagaaagcaggauuaaagagaaggaagaccuggcuaggucuggguggcgucugcagugccagaaagggaggcgguggcggcggcggcugcgaccacggccgcgcgggacgugaggcccgagagcaaccgacgggcagcggcggccgcuccagcgccccgcaccggggccguuagucagcagaacgcgagcucuuguggaggagcagggccggcgcgaggcgagacucgggagcgugagcggggccccuggggcgccgccguccuucuucgccccggcgccgggggcuguagcccugguccccgcuccucugucgggccagucugcaggcggagagagucggacggcgcccggagcgcggaucucgccuuguggaggacagcgcgucggcugcgguucucucucgaccccuucugcccggcgcuucggcccgggccgcucaggugcagagcaugaauaaucuuucauuuagugagcuauguugccucuucugcuguccaccuuguccagggaagauugcuucaaaauuagcguuuuugccaccugauccaacuuacacacugaugugugaugaaagcggaagccguuggacuuuacaucugucugaacgagcagacuggcaguauucuucuagagaaaaagaugcuauugaguguuucaugacuagaaccaguaaaggcaacagaauugcuuguauguuuguacguuguucacccaaugcgaaauacacuuuacucuucucacauggaaaugcuguugaucuuggucaaaugagcagcuuuuacauaggacuaggaucacggauuaauuguaauauauucucauaugauuauucuggauauggugccaguuccgggaaacccacagagaagaaccucuaugcagacauugaagcugcuuggcuugcucuuaggacaagauauggcauucgcccugaaaaugugauuauauauggccaaaguauagggacaguaccgucuguggaucuugcugcucgauaugagagugcugcuguuauucuucauucuccucugacuucgggaaugcgaguugccuuuccugauaccaagaagaccuacuguuuugaugcauucccaaacauugacaaaaucucuaagauaaccucuccaguauuaauaauucaugggacugaagaugaagucauugacuuuucacauggccucgcauuguuugaacguugccaaagaccuguggagccucucuggguugaaggagcaggucacaaugauguggaacuuuauggacaguaucuugaaagguugaaacaguuugugucacaggaacugguaaauuuguaaaauauucuguaaauuugcuacuggguuuuccuuucuugcugaacugcacucuuugguaaauaacauaaaaccugaagguuuuguuugcaaaucaugucaguugccuucauaaauguacagguaaugauuuguuaacagacuuaaugaagguuuuaauuaccagaacuaaaaacuggaaauaacaguaccgugcagucaggcuguguaauuuauauuuuuucugugaauuuuuuuuuaacaucaagaugaguacuguaugagauuuuaauucuauaaaaucaaaugcuguaaaaguauugccaaaugcuuuugcauacuagaaacaaauuuauaaauauuuuuaaaacaucucaauauauuaaaucuuauccuggaauacaacuguaauauuuugaaaaaagcuauguaucuaaagcaauuuaaguacucauaauggaaugaacuguaaaagagauuuaaaaccaugcaaguucacuagaauuaaccuaaacccuguuguacagggauagagguuuaaaguuauuuuauuguaaaauacauugaauuuucuguauacucugauuacauacauuuauccuuuaaaaaagauguaaaucuuaauuuuuaugccaucuauuaauuuaccaaugaguuaccuuguaaaugagaagucaugauagcacugaauuuuaacuaguuuugacuucuaaguuugguacugugaggcaaguacuuaaaauuuucaugcugguuacuuaaaaggcauuuagagauuucaagaaugauuuuguauacgauguuuuaaauuuugacugaucucauagucuucauagaauugcaguagucuucauuguaugaaaucccgaaaguccaugaguugaucuuaaagaccacuaacagacuggcuaucagaucccuuuucacuuuggcuauuuuuuucauuuuuugagauggagucuugcugugucacugaggcuggagugcaguggcgcgaucuugauucacugcaaccucugccucccgggaucaagugauucuccugccucagccuccugaguagcugguauuacagaugcuugccaccacgccuggcuaauuuuuguauuuuuaguagagacaggguuuugccauguugaucaggcuggucuugaacuccugaccucaugaucugcccuuggccucccaaagugucggaauuacaggcaugagccacugcgccuggcccacuuuagcuauuuuuaaaaauaggaccuauuguuuuggauuacuaucugagaauuucauggauucacuccuggguauaggagauaagaauacguuuaauucauaacuuuuauauuaaccaauauaguaaaaaaauaaagcucacacauacaaaaacuaaguugccuuuccuugaaugaacccugucugaauaaaacaaugaaaaauaaaaauaaaauuaaugguauguagucuaauuuguaaaugaaugaauauggaaauaauacacacuguggauauauuuuaaggccuuauguaguuuuaauuguucugcucguuccgugguuauguuuaagacuauaguauaugacucucuucaaaguauaucaaguauugugaaugcuuugguucagaugugucaaauuaacaguaaaacaacaaauauaccacugagugcagaaacauaaagaagggaagugauuuucucaaggucuacaguuuucaaugacgguacuauguauuccauuaucuucucuuuaccaaacuuaacuggauuaauauaccaaugauccuuucaaauuauaugacauaaacuuauuugcucuccaa

SEQ ID NO: 1412 - RNA, 14838 nt, Homo Sapiens
ggagggagcagucggucgcugcgccccggcgggccacuuucccgggaccccgcucgucuuccuugggccgagauuuuccacugcgccccuccgaguacccggguuccaaaccccuagccacgacauggaagaauuuuugcaacgcgccaaaucuaaacuguccauuccaaaugcagacauuuacacucgugaguauuaaagcaauagaucuuccuuaugacaacaaaaagcugacugcagaaaagcaaagcuucugggaaaagucuucgagcgcgucuuggcuuguucauagggggagaagaccugacuaauuagcuccagcccuucuaauccgaaggagcagaaauaauuaaaguaucuggggcaagcugugccgcacagcagcaggcuacagaaggggcgacgcgaggaacuugaugcauaggaugaaggaaagugagaaucgaagcaaacgcuuggagaagguccaugugguuauugggccuaaaucgugugacuuggauucucucauuucuaccuucacauaugcuuacuuucuagacaaggucaguccaccagggguucuguguuuaccagugcugaacauaccaagaacugaauucaacuacuucaccgagacgagguuuauuuuagaagagcuaaauauuuccgaaucauuccacauauuccgggaugaaauuaaccugcaucagcuaaaugaugaagggaaguuaucgauaacacuuguuggcagcagugugcuggcgagugaagacaaaacuuuagaaucagcaguugucaaagucauuaauccgguugagcagagcgaugccaacguugaguuccgagagucuuccucuucucucgugcuaaaggagauucuccaagaggcuccugagcucaucaccgagcaacuggcucaucgccucagagguagcauucuuuucaaguggaugaccauggaaucagagaagaucucagagaagcaggaggaaauucuuucuauccuggaagaaaaauuuccuaacuugccuccaagagaggacaucaucaacguccuacaggagacccaguucagugcucaggguuuaaguauugaacagacaauguugaaagaucuaaaggagcugucagauggagaaauaaaaguggccauuaguacugugagcaugaaccuugagguaagggugggaaugcuuuuuuagcauugauugauuucccacaauugcagucugagcaacuggaauguaacucucuccauuggauaaguccaugauaguccuuugcuucuuugugauacauuugacuuggaauauaguggcagguuauuauuugggugaaaacacuaugcuaagucaaugaaaaaugccaaaccuggauucucaagaugaaugcucuuucauucaucucaguaaaacaaagccuaaaacaaacacucagauguggguguauauuuaaccuguuuaauagcaauuaugauaugugugauuagguucacuuccauauuuucuguguaccacccuguauuguucauagaacuuuucuuaaaaaaaaaaaagaaaaaaaugagcaggauugagcuuuuccccaagggcacauggcuggugaauagagacgccuuucaauccaggaacucuggcuccaaaugcaugccugggaccacugugcuacagugcaccuuaagaaguuuacaaagaggaaaguagugguuugugaguuuaauguccaguauauauaauaacuaucaacugaauucaauugucuauuucacagcaauauuaccagugacuugaaagcauuuacagacaaguuugguuuugauguccucauccuguucuccagcuaucugucagaggagcagcagccgagacgacagauugcuguguacucagaaaacauggagcugugcagucagauuugcugugagcuggaagagugucagaacccuugccuagaacuggagcccuuugacuguggcugugaugagauccugguguaccaacaagaggacccuucagugacuugugaucaggugguucucguugucaaggaagucaucaacaggagguguccagagauggucuccaauagccggacauccucaacagaagccguggcaggcagugccccccucucccaggggucuucugggauuauggaauuguaugguucugacauagagccacaacccagcucugugaauuucauagagaacccuccagaucucaaugauucuaaccaggcucagguggaugccaauguagaccuuguuagcccagacagcggacuggcuaccauuaggagcagccgcucauccaaggagagcucuguuuuccucagugacgacagccccgugggagaaggugcugggccucaccacacccuucucccagggcuugacuccuacagccccaucccugaaggggcgguggcggaggaacaugcauggucuggagaacacggugagcacuucgaccucuucaauuuugacccagcacccauggcuucugggcagucccagcaaucuucucauucugcagacuacuccccagcagaugacuucuuccccaacagugaccugucagaaggacagcuccccgcugggccugaaggacuugauggcaugggaaccaacaugucuaauuauucauccaguucacuuuugucaggggcuggcaaagauagccuuguggaacaugaugaggaguuuguccagagacaagacagucccagagauaacucugaaagaaauuugagccugacagauuuugugggagaugaauccccuuccccagaaaggcuaaaaaauacuggaaagaggaucccaccaacacccaugaauaguuuaguagaaagcucgccauccacugaagaaccagccucacucuauacagaagauaugacccaaaaagcaacugacacaggucacauggggccaccucagacccaugcacggugcagcagcugguggggugguuuggaaauugacuccaaaaauauugcagaugcguggaguuccagugaacaggaaucuguuuuccagagcccugaaucauggaaagagcauaagccaagcuccauugauaggagagccucagauucuguauuucaaccaaagagccucgaauuuacaaagucaggucccugggagucugaauuuggucagccugaacuggguagcaaugauauucaagacaaaaaugaggaaagcuugccguuccagaaccugcccauggagaagucaccuuugccaaauacaucuccccaaggaacaaaccaccugauagaagacuuugcuucuuuguggcauucuggucgcucucccacagccaugcccgagcccuggggaaauccuacagaugauggugaaccagcagcuguggcgccauucccagccuggagugcauuugguaaagaagaucaugaugaagcuuuaaaaaauaccuggaauuugcacccaacaagcagcaagacaccuucuguuagggacccgaaugagugggccauggcaaaaaguggguuugccuuuucuucuucagaacuacuggacaauucacccagugagauaaacaaugaagcagcuccagaaaucuggggcaagaaaaacaaugacuccagggaucacaucuuugcaccuggaaaucccaguucugaucuggaucacacauggacuaauucuaagccaccaaaagaagaucagaaugguuuaguggauccuaaaacuaggggcaagguauaugaaaagguagauuccuggaaccuuuuugaggagaauaugaagaaaggagggucagauguccuaguuccuugggaagauuccuucuuaucuuacaaauguucugauuacagugcauccaaccuaggagaagauucggugccuucccccuuagauaccaauuauuccaccucagacucuuacacaucaccaacauuugcuggagacgaaaaggaaacugaacacaagccauuugcuaaagaggaagguuuugagucaaaagaugguaacuccacggcagaggagacugacauuccuccucagucacugcaacagucaucucgaaaucgaaucaguucagguccugggaaccuagacaugugggcuucaccucauacagauaacaguucugaaauaaauaccacucacaaccuggaugaaaaugaacucaagacagagcacacagaugguaagaauaucuccauggaggaugacgucggggaaagcagccaguccaguuacgacgaccccagcaugaugcaacuguacaaugaaacaaaccgacaacucacacuuuugcacagcagcaccaacucccggcagacggccccugacagucucgacuuguggaacagagugauuuuggaggauacucaguccacugcaacgaucucagauauggacaaugauuuggacugggaugacugcagugggggugcggcaauccccagugauggucaaacagaaggauacauggcugaagguuccgagccggaaacccgauuuacagugagacagcuggaacccuggggcuuggaguaucaggaagcaaaucagguagauugggagcucccugccucugaugagcauaccaaggacagugcucccagugaacaucacacauugaaugagaaaagugggcagcuaauugcaaacaguauuugggauucugucaugagagauaaagacaugucaucauucauguuaccaggcuccucacauaucacagauucagagcaaagggaauugccuccugaaauccccagccauucagcaaauguuaaagacacucauuccccagaugcgccagcagccucuggaaccagugaaucagaggcacuuauaucucaucuugacaagcaggacacagagagggaaacccugcaaagugaugcagcauccuuggcgacuaggcuugagaauccaggguauuuuccacacccagauccauggaaaggucauggcgauggacaaagugaaagugagaaggaagcccagggagccacugacagggggcaccuugaugaagaggaggugaucgccucugguguggagaaugccucagggauuucugaaaaagggcagagugaccaggaacugucuucucugguugcaucugaacaucaggaaaucugcauuaaaucaggcaaaaucagcucucuugcugucacuuucaguccucaaaccgaggaaccagaggaaguuuuagaguaugaggaggggucuuacaaucuagacucccgugaugugcaaacagggauguccgcagauaaccugcagccaaaagauacccaugaaaaacaccucaugagucaaagaaauucaggugaaacuacugagacuucagaugggaugaauuucacaaaauauguaucuguaccugaaaaggaucuugagaaaacugaagaauguaacuuucuagagccagagaacguggguggagggccaccucacagaguuccccgaagucuugauuuuggggacgucccuauagacagugaugugcaugucagcagcacauguucugagauaaccaaaaaucuugacguuaaggggucugaaaauagccuuccaggagccgguucgucuggaaauuuugacagagauacuauuucuagugaguauacucauucaagugcaucaaguccugaguuaaaugacucuucaguugcacuguccuccuggggccagcaacccaguucuggguaucaagaagaaaaccaaggcaacuggagugaacagaaucaccaagaaucugaacuaauuaccacugauggccaaguagaaauaguuaccaaagugaaggauuuagagaaaaacagaauaaaugaguuugaaaagagcuuugaucgcaaaacuccuacauuuuuagagaucuggaaugacucaguugauggugauuccuuuuccucuuuauccaguccugaaacaggcaaauauucugaacauucagggacacaucaggaaagcaaucuaauugcuagcuaccaggagaaaaaugaacaugacauuucugcaacugugcagccagaggaugccagggucauuucaacaagcucagguucugaugaugacagugucgguggugaagagucaauagaggaagagauccagguggccaacugccacguugcugaggaugaauccagagcuugggauucauugaaugaaucuaauaaguucuuggucacagcugauccuaagucugaaaauauuuaugacuaccuagacagcucagagccagcagagaaugagaauaagucaaacccauucugugacaaucaacaaagcagcccugaucccuggacuuucucaccauuaacggagacugaaaugcagauuacagcaguggagaaggagaagagaucuucuccagaaacagggacaacaggagauguugcauggcaaauaucucccaaagcuucguucccaaagaacgaagauaauucucaacuggaaaugcugggcuucucagcugauagcacugagugguggaaggccucaccccaggaagggagacuaauugaaaguccauuugaaagggagcugucugacuccagugguguguuggagauaaauucuucaguacaccaaaaugccagucccuggggaguaccaguucagggugauauugagcccguggaaacacacuauacuaauccuuuuagugacaaccaucagucacccuuucuggaagguaaugggaagaacucccaugagcaacucuggaacauucaaccaaggcagccagacccagaugcugacaaguucagccagcuuguaaaauuagaccaaauuaaagaaaaggacucaagagagcaaaccuuugugucugcugcuggugaugagcugacuccugaaacaccuacccaagagcagugucaggacaccaugcugccagucugugaucauccggacacagccuuuacucacgcagaggaaaauaguuguguuacaucuaauguuucaacuaaugaaggucaagaaacaaaucagugggaacaagaaaaaucauaccuaggugagaugacaaauucaagcauugccacagaaaauuuuccugcugucaguucucccacccaacugauaaugaagccaggcucugaaugggauggcucuaccccaagugaggacucccgagguaccuuugugccagauauuuuacauggcaacuuucaagagggugggcagcuggccucugccgcgccugacuuguggauagaugcuaagaagcccuucaguuugaaagcagauggugagaauccugauauccugacgcacugcgaacaugacagcaauucucaggcuuccgacagcccugauauaugucacgauucugaagcaaagcaagagacugagaagcaccucagugcuugcaugggaccugaaguggaauccagugagcuuugucucacugagccagagauagaugaagaacccauuuaugagccuggacgggaguuugucccauccaaugcagaacucgauucugaaaacgcaacugugcugccuccaauuggcuaucaagcagacauaaagggcuccucucagcccgccucucauaaagguucaccugaaccuucugaaauaaacggugacaacaguacagguuuacaaguaucagaaaaaggagccagcccagauauggcaccaauuuuggaaccaguugacagaagaaucccaaggauugaaaauguggcaacuagcauuuuuguaacucaccaagagccaacuccagaaggugacgguucuuggauaucagacagcuuuucuccugaaagucagccuggugcaagagcuuuguuugauggugauccacauuuauccacagagaauccugccuugguuccugaugcuuugcuagccucagacacuugucuggauauaagcgaagcugccuuugaccacaguuucagcgaugccucaggucucaacacauccacgggaacaauagaugacaugaguaaacugacauuauccgaaggccauccggaaacgccaguugauggggaccuagggaagcaagauaucugcucaucugaagccucguggggugauuuugaauaugauguaaugggccagaauaucgaugaagauuuacugagagagccugaacacuuccuguaugguggugacccuccuuuggaggaagauucucugaagcagucgcuggcaccguacacaccucccuuugauuugucuuaucucacagaaccugcccagagugcugaaacaauagaggaagcugggucuccagaggaugaaucucugggaugcagagcagcagagauagugcuuucugcacuuccugaucgaagaagugagggaaaccaggcugagaccaaaaacagacugccuggaucccagcuggcugugcugcauauucgugaagacccugaguccguuuauuugccgguaggagcaggcuccaacauuuugucuccaucaaacguugacugggaaguagaaacagauaauucugauuuaccagcagguggagacauaggaccaccaaauggugccagcaaggaaauaucagaauuggaagaagaaaaaacaauuccuaccaaagagccugagcagauaaaaucagaauacaaggaagaaagauguacagagaagaaugaagaucgucaugcacuacacauggauuacauacuuguaaaccgugaagaaaauucacacucaaagccagagaccugugaagaaagagaaagcauagcugaauuagaauuguauguagguuccaaagaaacagggcugcagggaacucaguuagcaagcuucccagacacaugucagccagccuccuuaaaugaaagaaaaggucucucugcagagaaaaugucuucuaaaagcgauacgagaucaucuuuugaaagcccugcacaagaccagaguuggauguucuugggccauagugagguuggugauccaucacuggaugccagggacucagggccuggguggucuggcaagacuguggagccguucucugaacucggcuugggugaggguccccagcugcagauucuggaagaaaugaagccucuagaaucuuuggcacuagaggaagccucugguccagucagccaaucacagaagaguaagagccgaggcagggcuggcccggaugcaguuacguugcaggcugucacccaugacaaugaaugggaaaugcuuucaccacagccuguucagaaaaacaugaucccugacacggaaauggaggaggagacagaguuccuugagcucggaaccaggauaucaagaccaaauggaucaugugaccagaaaauggaggcgaaucuguauuuccaguuaacugcucagaagagagaugcugaagagcuguagucgugcauccuucucacccuccguuagaaagccuccucucauccucagaagauuuuaaauucucugagagcagaaugugucucugauccauucuuuuuguaauacagccucccccgaggcuaacacuuuccauauggcucuaggacucaaauguuuguugaacuccuaccggaaugaauggccugagaaacaaacaacuacugucagaggauguaggaauggacauccccuuugaagagggcgugcugagucccagugcugcagacaugaggccugaaccuccuaauucucuggaucuuaaugacacucauccucggagaaucaagcucacagccccaaauaucaaucuuucucuggaccaaagugaaggaucuauucucucugaugauaacuuggacaguccagaugaaauugacaucaauguggaugaacuugauacccccgaugaagcagauucuuuugaguacacuggccaugguaagucacuaaguuggcaaggccaaaguuaaaugcuaaauaaguaaaagauuuucuaacagaccucucauuuuugugccaguggauccuuuuugugauuucuagaagcuucuguuuuuauuucagguuauagguggccaugauugacaguuuggagccugacagagaaaguaugggucacagaggccauacauaaccauugcucuuuauuaacccccacucugugcuagcauuuaugcuaggcacuggggcugagggaagacuguuacaugcuguguuacaagaaaccuggggcuggguuugcaggggaagagaauuuaaucaggacgauaaaauuugaagaagagaaaucagagcuugccaauuucuuguauaaguucccacuaucugcaauguucuuuuccccagauccuuacgugacugacuccuucucuuuauucagauguuaaucagaugucaccuccucagagaagucuuccuugaccucuguaaucaaagaugcuucccacuucccgucaguuaauaaaagaagacuucauugaguguacuuuauauggucaggauagugcuaagcucuguaaaggcuguacaaaacaaggacuuugaucagguuguuucugcaggaugaaacaaaacaaaggcugcccguaggaguacuguauuguaaagcuuaccauuuggcuguuuagcugcacuguggaggucuugcuccuucagccuugcucugugcuuuguuuccagaagaucccacagccaacaaagauucuggccaagagucagagucuauuccagaauauacggccgaagaggaacgggaggacaaccggcuuuggaggacaguggucauuggagaacaagagcagcgcauugacaugaaggucaucgagcccuacaggagagucauuucucacggagguagucgagcucagcaugaaucugggaaauggggaaggggcagccauuuuauuuaaaaucaugaagugagucuagacuucuccggaacaugacaucucaaagacccuauucuagagccaauauucagggaacuauagagcuaaguauauuuccucauauucaauucaauaaacauuugaaauccuacuaggcaaagacaacuuuccaauauaaaacgggcuuuucaugcuacauaucugauagagauucagguaaccuucucugaagucuugcugggauacuauggggacggucuaaaugccaucauuguguuugccgccuguuuucugccagacagcagucgggcggauuaccacuaugucauggaaaaucuuuuccuauauguaauaaguacuuuagaguugaugguagcugaagacuauaugauuguguacuugaauggugcaaccccaagaaggaggaugccagggcuaggcuggaugaagaaaugcuaccagaugauugacagacgguugaggaagaauuugaaaucauucaucauuguucauccaucuugguucaucagaacaauccuugcugugacacgaccuuuuauaaguucaaaauucagcaguaaaauuaaauaugucaauagcuuaucagaacucagugggcugaucccaauggauugcauccacauuccagagagcaucaucaauuauguacgaugaagagagaucuuauaagagaagugugagacuggaugaagaacugagggaagcaucagaggcagcuaaaacuagcugccuuuacaaugauccagaaaugucuucuauggagaaggauugggaacccauuugaccuucugaaaaacaagcuuuucuuuaguuauaaacauccaucucaguaaguauugacuugaagcugaaagaaaagccuuaguuggccaugcuggaagaagaggaugcuuuucugguucaugguucuguugaaacauaucuaccugaaagagacagggcugauguuaccuuuuuccacuuugcacuaccuggugccauucuaaauuucuaaggggaaaaauagaaaguuuguuuacucuuaagauauuuuaugaaauuguguguacuuuccuauuuugccaauuaugugccucaaagauuuuaguugagccuuagcaagaaaguaggaccuuccauuucaauacuucauuaacacgguguagugauacuuugucccuuagacugguguuuaccaguaagauaccuuuaauccacuguuaaguaugaguggauuuguuuccauagauuagcuggauuuccuuuuggugauugcauuagguuuaaaguacacaggucucaacucuccccaggaaaguuuccccuguuugacuccaccuuuaaaauccuaagccugacuaggacagccacaaaccacacaagguguaaaaccaucaucagcuaagugcccguuuuguucuuguuuaccagaaucuccuuuaacuucucaaagggaagccgggcuuucuaauccacgucaacuuuauuuuaguugucaaauugggcauuauauuuuauguaaauuggucuuuuaacaucauuuuccugaugaauguuggugaccaccacauugugaaauuuaagaauccguguugcauguuugguagcucucugaguuucaggccauaaacucagcuccagagguuaccuuuuaagugccaagaacucaagugcaagguggccuacucaaaaaucauuugguagcauucaguuauucaugaauuccucucucgcaugcauuauaaaaagugaucugcuuuaaaacaccguaaucugaucauaggcuuaaaauuaaauaugaguauuacuuucauguacaaaauauuuccuuuauagucuucauaugcccuuuaaaaugccaacaagauuucaagucuguaggccucuagugaggugggguggcaaaccacagcuaagucucgcucaccacugcaagcuaagaaugguuuuuacauuuuggguuggaaaaauuuuuuuugaauauuucaugacacaugaaaauuauucaaauguuagugccgauaaauaaagugguacugaaacacagccacacaaacuuguuuuuguacugucuacagcuacuuucacacuacagccgcagagcugagcaguucagcagaccguaugucccacaaugccuaaaacauugacuauguuuacagaaaaaguuugcugaccccugcucuagcaaacgcauccuuuccuacuccaccccaauuuguauuuagauaguuucucuaacagaacggacaaaugaggcugcaaacuaauuuauuuuugucaaaaaucaauguuuugacauccacagacagugaaauaaaagaaauggcuugcugaaaaacaugaggaguccuagccacaaaaucacugcuuagguugcaauugccaaaaugaagccuucuuagaagcacuucuuuaguauauacagguguuggcugaaguccgugccucacucugggaaccauucuuagucuccagugucuccuauuacaaagaagcuggcagaaauaaaaaugaaggggugagagcgguuccacccuagucucaugguggaaaauucauuggggagagcuguccaggauauuuggaguccuggguagaaggagcuuguaacuacuuuaaagucgacaucuuugcacaggugauugaguuucucugaccucauugcuucaccucugucuccucccguccuuccgcacgugcccacacacacgcaguucagcccucuuuccuccauaagccuccaucguuuucucuuuucuccucuugauccuuucaagcgaguaucuuguugaauuguauguucuguuggaucuccuccuucauaacaucuggcuuguuggacagaaaaacccuacagcccacccccucccacagcccaccuccacuuuugaaagcccaaauuacaccucucccagaacacaguguugacguaaauacaguuacccaauauuccuguuuguucaccuauuugcuacuuucacucaguagcaucccauuuuguaaaaugaauuccauggucacccugucacaggaaguaaugaaaaauccaguguucaguguaguggugcaaaccugagggcauagagcuguucauagagggcucuuguuauagccaaacagacacagcaacaaucucaccauuuauauauauauuuuuaacuuguccagcucaucuauggaaaacuacucaggugguaugcuguuugaagccucaucuuccuacaugaaaauuaugggcauuugucccaaugauuuuguuucagcuguucuguaggcugcauaaccacucugauauuuagguaucugcuauuuuauuaucuuaaaagacaaauuaauuuaauugcaugugcuagggaaaagcuaccauguacauucaccccaaguaaauagaauccuagaugaauccuagaaaaauaaucccuaagcagauagguagacagagguaaacauucacaugauuuagcucucuagcucuugcacucugaacauucuugcuuugguucugacuucugggaacugcuuugcauuucuccuauagaucuguaguuaagggaaccaaggggucauuggggcaaaagcauuguuucucaaagcuccuugauuaagagaaagaacagaaauuugcacagaagauagugucaaggagugagaaaguuuguuugagggcaguagcucaguguggaagaaaauccugaaguuucuguugaagccauacaauguucuaugggguuacucucuaagacauucucugaggugugugaggaagucacuacuccuagccuuuguuaagauguaauuuuaaauauucaguuaugguacuauguuugcaacucucgucuuaucacaaugccucaguaguuuguucccuuagaaacauuuagaugugcacaaauuaaucuuuuauauaucuaaagguuuuucuaucaugcauuggauugcucagaauaaagugucuguuagacuucguuuugguaaauaaauucuccauaauguagauuaauaauauaaaagucuuuaaugacacaauauaucuauauagccucacuguauaauucagaaauaaaaauugauucugca

SEQ ID NO: 1413 - RNA, 465 nt, Homo Sapiens
aagagauguuaacaggcuguaugauguuggccacagagugccccccuaaagaggccucagaagaaugaaggguaagaagcuccuccaugaaaucagauggcacaaaauuagaggaaaaagaguccuuggcaugaggcugccaccaggagaauucugaagaugcagggcaugaauggucaaugccuuucguuguuggggcagagguggaugacccaccagagccaccuagagauaacauuuccggaaaagucuucaagacguaaaccaggcauuacccaagucccacuucgcuguuuggagcccuuaacuuggaccccaccaacuacacugccuugaaagccugaaauacugccuggaauauuuguuguacccaggcuuuucuacucucaggaucacauauguccucaaauccgucuuaucuacaguauguuuuugccuuacauaaaugcagauauaaaacuuaaa

SEQ ID NO: 1414 - RNA, 6649 nt, Homo Sapiens
aaaguggcgagagccaccucggcgcuugggcgcucagucgcaggaggcgcuccuuggcggugccuggagcccgggcgcaccccaccgcucccgggaccuguugggggcuggcccgaaccgucgucgaagggagccgcucggccacccccgacguuccucgccccgcccgacguucccucaaguggccgaaccagccggacgagccaaacucgccgggccucccggcggcagcagguggccccguccuuccagggagggcccugcgccccgcggcgcuccggagcccucucggccgcccccgccaggcgggauggaggcggauggggacggagaggagcuggcccggcugcgcucagucuucgccgccugcgacgcgaaccgcucggggcgccuggagcgcgaggaguuccgggcacugugcacggagcugcgggugcggccggccgacgccgaggcaguauuccagcggcuggacgccgaccgugacggcgccaucaccuuccaggaguucgcgcguggcuuccucgggucccuccgcggggggcggcgccgggacugggguccucuggaucccgcgcccgccgugucugaggcggggccggagacacacgacagcgaggaggacgaaggcgacgaggacgcggcggcggcgcuggccaccucgugcggcccggcgagucccggccgggcuuggcaggauuuccaggcgcgacuuggggacgaagccaaguucauucccagauuuggcuacacaauuucaaaaccugcauuuguguucgugaggcaucucauaacacugugugcauugucaugggcuaaaaaggaaggcagagaaacacuuuggacaaucgaggagggaggagccaagauggccgaauaggaacagcuccggucuacagcucccagcgugagcgacgcagaagacgggugauuucugcauuuccaucugagguaccggguucaucucacuacggagugcgagacagugggcgcaggccagugugugcgcgcaccgugcgcgagccgaagcagggcgaggcauugccucaccugggaagcgcaaggggucagggaguucccuuuccgagucaaagaaaggggugacggacgcaccuggaaaaucgggucacucccacccgaauauugcgcuuuucagaccggcuuaagaaacggcgcaccacaagacuauaucccacaccuggcucagaggguccuacgcccacggaaucucgcugauugcuagcacagcagucugagaucaaacugcaaggcggcaacgaggcugggggaggggcgcccgccauugcccaggcuugcuuagguaaacaaagcagccuggaagcucgaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagauggagaucugagaacgggcagacugccuccucaagugggucccugaccccugacccccaagcagccuaacugggaggcaccccccaacaggggcacacugacaccucacacggcaggguauuccaacagaccugcagcugaggguccugucuguuagaaggaaaacuaacaaccagaaaggacaucuacaccgaaaacccaucuguacaucaccaucaucaaagaccaaaaguagauaaaaccacaaagauggggagaagagcaaguuaguaccuuguaccaaaacaucaaccuuguggagccaagauuaauucagccauaugaacauguuauaaagaacuucauccgugagaucagacuucaaagcacagaaauggaaaauuuggccauugcggugaagagagcccaggacaaggcagcuaugcaguugagugaguuggaagaggaaauggaucagaggauucaggcugcagaacauaagacacggaaagacgaaaaacgcaaagcugaggaagcccucagugaccucagacgucaguaugaaacugaaguaggagaucugcaggugaccauuaaaaagcuaagaaagcucgaagaacaaucaaaacgcguaagucaaaaggaagauguggcugcauugaaaaaacaaauuuaugauuuaucaauggaaaaccagaaaguuaagaaagaccuuuuagaagcacagacaaacauagccuuucuucagagugaguuagaugcuuugaaaagugauuaugcugaucagagucugaauacugaaagggaucuggaaauaauccgagcauacacagaagaucgaaauagucuugagaggcaaauugaaauacuccaaacagcuaaccggaagcuacaugacaguaaugauggccuuagaagugcccuugaaaacaguuauagcaaguucaacagaucuuugcauauaaauaauaucucaccagggaauacaauuucuagaagcagucccaaauucauuggucauuccccucaaccucuaggcuaugacaggucaucccgcucuuccuauguggaugaggacugugacucccuggcccucugugauccucugcagaggacaaauugugaaguugacagccugccugaaagcugcuucgacagcggcuugucuaccuugagagaucccaaugaguaugacucagaaguggaauacaagcaccagaggggauuucagaggucacacggggugcaggagagcuuuggaggugaugcuucagacacagauguuccugacauaagggaugaagagacauuugguuuagaagauguggcuuccgucuuagacuggaagccccaagggucuguuagugaaggcagcauuguuaguucaucaagaaagcccaucucagcacucucgccccagacagaccugguagaugacaacgcuaaaucuuuuagcucacagaaggcuuacaagauuguacuugcuggggacgcugcaguggggaagucuaguuuccucaugagacuuugcaagaaugaauuucgagaaaauauaagcgccacccugggaguugauuuccaaaugaaaacccucauuguggauggagaacgaacaguucugcagcucugggauacagcuggucaggagagauucagaaguauugccaagucuuacuucagaaaggcagaugguguuuugcugcuguaugauguuacaugugagaaaagcuuucuuaacauacgagaauggguagauaugauugaggaugcagcccaugagacuguucccauuaugcugguaggaaacaaggcugacauucgugacacugcugcuacagagggacaaaaaugugucccagggcacuuuggagagaaacuggccaugacguauggggcauuauucugugaaacaagugccaaagaugguucuaacauaguggaggcuguucugcaccuugcucgagaagugaaaaagagaacugacaaggaugacagcagauccauuaccaaucuaaccgggaccaauuccaaaaagucaccacagaugaagaauuguugcaauggcuaaaucccaaacauccuuggccugugaagucuucauuuccagaauacugaauuugugugacuuauuuggcucuuaacagaguggcacauccuacugacacuguccuauggagaguuacagugcaggaaaccugaacccagcucucaggucccucuggaacuuuggcucuucuuuguuuugucucagugagugauuugggcccucuggcuaaauagacuagucauguccuuacaggucuuaaaagauaacauguaaauguuuuuaaaaugguaaaaaaaaagaaaagaaaagaaaucacaugcucagaucaaagcuguagaggaaacugacauaauuagauucaugugguagcugaauuagguuacccacaaagucagcauuuaaauauuugauacuaaaguucuaguaagaagggauucucauccuagcuuugcuguuaacuggccuugugaccuuggacaugucacaagcccaugucggaucuguuucuucaucuguaaaaugugcagcuugcccucaaaggccuugcagcccuuggcaccucagauucugugggaagcaguaggacagagagugugguggcccacaguuaauaauagaacuaugguuauuccugcuuuuuaauauuggaguauugauuuuucucacuucugaaauaaggacagaauuugauuaaaaaauggaaacagaaauaucuauuuuuuauguauaaagaaacauguuugagacaaaaauaguuguauauaaaaggauauuucauaaucucagaauaguuacaaagcucacugcuugaauuugguguuaaaaauucuaauggaaacauguaaagccacauacuacugaaagcacaaugcccaggaaaguugucacucuucacuuaagggagugguugccaggggcugagaaagggaggauggggagugacugcuaauagguaugugguuucuuugggcgaugaugagaauguucuggaauuggaauaguggugauaguuguauaacuguuugaauguacuaggaaccacugaauuguauacuuugaaagggugaauuuuaugguugugaauuaucucacuaaaaaaaaugcuaguacuuagagugauguaacauuuugcaaaauuuucauuuucguaucccugcugauuucaaaccuucccaugguuuagaagcauaaccuguaauguaaugcaaguccccuaacucccugguugcuaacauuaacuuccuuaaguaauaaucaaugaaagaaauucuaugcaugguuuugaaauaauauccuugaaagaggaaucaccauuaggaaaggugagucaggguccuuuguuuaaugugacuaguggcucaucaucaccagugaccugguugggccuacucuccuuccagaaccugcauugcuucccagaccuccccacugagaugccucuaagagccaaaggagucaacacuugagccuagggugggcuacaacaaaagauucuaauuuaccuugcuucaucuagguccaggccccaaguagcuugcugaaggaacuuaaaaaguagcuguuauuuauuguauuguauaagcuaaaaacauuuauuuuuguugaaucgaaacaauuccauguagcaaucuuuuuucuguucacgguguuugugauagaaccuuaaauuccgcaagcaucaguuuuuugaaaaaaugggaauugaccggauaguuacaggcaaagauuauaaauagcuacaacaucauuuaacuuuuauaaacaugccuucucucuauugaagacaucugauauuuuugcuggaaaguuggaucuauccucaguaacucugccaugaauuccuguuuccugguuccagaaaaagaaaagauuacauuucugaucauaaagaaugucuugcauaugggaaauuuuucaaaauaagggggguauuauuuauguggcaugggaaaacuuuugccauggcuguuugucuuaguggcaucuuuugaugacauuggaucagauauauguagaugcugauauaugggacacauguuuagguuuuggugcaguugcacaaaacuguguuaguuuauauguuacuguguugccuuuauuuauucucuccaaagugucucuuuauauuuguuuuacaaucugugaaagaguauaccauaauacagaaguauuuucauagucuuuaccucuggauuguccugucaguauagccacguugaugagauuacaccagugccuuugauggucaaccaaucaucuuuaaguauuugagcccugauaaauauuuugguaacauaauccaaauuagagacuuagagcucugguuagcaaucauguuuaaagagaagcuucuuaaagcucuguaugcugggagauucaugauuauuaccaacguuuugauuucaugaagguguucucaaauuuaaagcacauuuucaguaagaacaaaaauauuuaauguuuuuaucuuagacuugauacauuugcauauuacuauggaaguuauucaccuugucccuguuuuucuuuaagauauuuuaaaaucauaguuauacuacaguccuuuuuuaaauguauccugauacauuguaaaauauuuuaauuucauuguggaaaauaauguuggauaaggagauauuuuucacuguuaacuuuuagcccaugcauuuucauaauuuauuuuuuucacuugcugcuuuauaugacauaugugacauuugauuauuuaacacuugaugugaucugcauaaacccaaguugcacaacccuccugcugaagauaaaauugagguuaaagauaaagauuuauuuucauauuuguacagugaucggcuucagugaugguuuuugugggcauuuauuguguguguguaagaaauuucauauguauauauuaaguaggccucugaguauugaauaauuguuuuaugauuuugauuuauaugguuuacauuuucauugugugggccauauuucguuuauacuguuuauuucucuucaaaccuuaauaauuauaccauaaaguguaauuuuuauagcaaugcaaaugucuaaggaacuacaaauauuuucuacguuguaaauucaauaaagcuugcuuccuuuggccuuuu

SEQ ID NO: 1415 - RNA, 887 nt, Homo Sapiens
ggggcugggccuuggggcugcuggaugaaugagacccagccucugcccugggagugcagagacucaagacagauaugaccacgugaagagacaacuguaaaacaaguggaauuagagaauaaaaucccagcacgauguuccucacuggagacaccaguccagcugaggacaauagagaagccacccuuccucaauguucacuuccagaauuauaugcauguauugagaauuuuaauaaggagagcaagaaaucaaaucuucuaaaaaugcaugguauuucacuuaacgaagcacaggaaguacuugcuagaaaccugaaugucaugucauucaccaggggcgcugaugugagaggagaucuccaaccuguuaucagugucaauaaaaugaacaagccuggaaaacauagaaagaccccaucuccaaaaauaaauaaauaaauaaauaaauaaauaaaaauuagaaaacaauucaugaaucuaagggaucuggaauggagauauuuuaaggggcuugcgaaguggaggcgcacuacugcaauuucauucggagacauaaaauacaacacugagaagagauuuguagagagccaggacaugccugacguuauuuuccccccuauaguucgcaagucuuuggucauuuauccucaaauugauuaucaaaaugaaggaaguuauucucuuaaauggaauauguaguguauuaaaauauuuuggacguagauuuuugcuuuugagagcauugauuuaauacacaaaaaguaaagaagccaaguacccaauagaacaucugaagugaguguguacaacacacaugaagguauauuguaaaauuaagccguuaauacagagcaaaagguccgauuuaaucugcuaacgugagaa

SEQ ID NO: 1416 - RNA, 95 nt, Homo Sapiens
gccaccaagaaggugaagggagggucagucccaaucugaaucccaccaaaauaggugguagaggguugcccuccuuucuucccucaccucugacc

SEQ ID NO: 1417 - RNA, 136 nt, Homo Sapiens
gcccugugguugcuggaugcuguugugcauggacagcucuccaguggauucgaugggccauagcaauccugugauuuaugcauggaggcugcuucuccucagcagcugccauagcccggucgcugguacaugauuc

SEQ ID NO: 1418 - RNA, 204 nt, Homo Sapiens
uguccugggggaauaauuauguucccugucuugggagccuuucuucagggagcuugaugguuccaacccacccaggagccugggacaucugugccccugggcaauccccugcaguuuccugauuccaagaugaggggguagaauccgaagaucuccaaggccuugaugagugcuaccagucugcaaauucccaagccaaguucu

SEQ ID NO: 1419 - RNA, 6170 nt, Homo Sapiens
ggggccuggucuggccaauggaagcacagagugcaggcucaguggucacguguccagcgggcgggaauuuuaccccaggaagagaugcaggaggcgauuuuuaccucagauguugaaauuuacacugcuuugaaagaaagaagauauguuuucagcauugaaauaucaugcaauagacuauuuauaugagaaugugguuagaaagaaguuuuacagagaugcuuuauugcuucgaaucccuucauguuuauaucaagaugaaaguuaccauguagcaguuacugauaauaaauuuaggaggccauggacgagagaauucuaaagaagaaagugcuucaagaaggaaguaguaguccaauguguugggcuccuguuaaaagcucaaguuaugugaggauagugaguugaccauuagcuugacuaaauucucagcuguuucaguuccgggaaugacagauaccucagucuuggaccaauggaaagcaaguuucuuuguggaggauuuccuugagaaaaaaacaauuacaagaauggugacccagauuaauugugaauuugaggaaguuguuccaaguucaaauccagacucccaaauugaaguagaggaggucaguuuauacacccacauggacuacaaugaagucuuuaccccugucaguuguuuagaaaaauguucagcacuucaaaaccagaaccaagagacagcuagccaagauucuaaagaaacccagacaaggcaggguggagaccgagaggagaaauuuauuccagaaauuaacuguuagcaguaguguuucuuaauacauaagcuauaucauacuccucaaguagauucuuugcuuaaaacuuucacuguaaauaauuuuauagcaaccaugugaauaacuuaagaauaauagaaucagucucauuuguaggcacuguagaccaucuccauucccuacaugucagagacucugggggaugaauuggagauauuaagagguaaaaugaugcagagaagaccaaggucagcagaagucaaauacuucuauuucuuuaaaauuuugcuuaggcuacgccuggcuauuuugaaguauuuauuuauugaugauaaaggaauacuuuuuguaaguaguagaaaacaccuaccaacuuugccuacucucuugaguagacuaaaacuguuuuugguaaaggauccucuuuuagauuucaaaggacagaucuucacagaagcuaauuuuuccagggaauguuucucucuucaagaaacuuuggaagcuuuugugaaagaagauuuuuguauggauaaagugaacuuuugucaagagaaacuagaagauacaauauguuuaaaugagccgucaaguuuucuuauugaguaugaauucuuaauaccuccaagccucaaaccagaaauugauauuccaucacucucagaacugaaggaguuauuaaacccagugccagaaauaauaaacuauguagaugaaaaggaaaagcuuuuugaaagagaucuuacuaacaagcauggaauugaggauaucggggauauaaaauucagcuccacagagauuuugaccauucaaagccagagugaaccagaagagugcaguaaaccaggagaguuagaaaugccacuaacuccucuauuccuaacaugccaacauucuucagugaauucauuacguacagaacuucagacauuuccauuaucuccgguuuguaaaauuaauuugcuuacugcugaagaaucagcuaaugaauacuacaugauguggcaauuagaaagauguagaagcccuuugaacccauuuuugcuuacagugccaagaauucaagagccccacagccaauauucaguuacagauuugaaaaagauauuuucuguuaaagaagaaagccuugugauuaaucuggaaaaggcagagugguggaaacaagcaggacuaaaucugaaaaugauggaaacauuggaacaucugaauacauauuuaugucaugauaauuugucuucuaaugacacuaaaauugagauauuuuugccuacgaaagugcuucaauuagaauguaaguacaucacaguaaauauuaguuauguaaacauuuucagaaugugaaaauguuagauucuggauuuccucuagguaauugggaaaaucacuagguucuagcauuccauauaggcccuggcucugccagaauuuaugacuuuggauuucucuaggucccauuuucuugaaaaaaugaugaaguuugacuagcuaacccuaaaaucuuguuauguccuaaaauucuauagucucaguuuuuaaauuucuagccauuuucauuuaaagugacuuuguuuccuuuuauaaaugauuaaauugcuagcaguuuccguucacauuggccuagacgcaaaccagcauuuugcaguaacuguuuuuugaccuaacagcugaacauuagcauucaauaauaucacucuuuaacaaucaugucuagaacauaaaagucauucuucaccuauugcacuuauugaugaaaaaucuacaaaugcucauuuaucacuuccacaaaagaguccaucucuggcaaaagaaguaccagaucuauguuuuucugaugacuauuucucugauaaaggagcagcaaaagaagaaaaaccaaagaaugaccaagaaccaguaaacagaauaauccaaaagaaagaaaauaacgaucacuuugaacuugacugcacaggaccaucuauuaaaucaccuuccucuucaauaauuaaaaaagcaucuuuugaacauggcaaaaaacaagagaaugauuuggaccuuuugagcgacuuuauuaugcugcgaaauaaauauaagacuugcaccucaaagacugaagucacaaacagugaugaaaaacaugauaaagaagcauguucuuugacacuucaagaagaaaguccuauuguucauauuaauaaaacccuggaggaaauaaaucaggaaaggggaacagauagugucauugaaauucaagcgucagauagccagugccaagcauuuugccuccucgaagcagcagcuucuccuaucuuaaaaaaccuuguauccuuguguacccucccuacugcuaauuggaaauuugccacuguuauuuuugaccaaacaagguuucucuuaaaggaacaagaaaaaguaguaagugaugcuguucgccaagguacaauugaugaaagagaaaugacuuucaagcaugccgcucucuuacaucuucugguaacaauuagagauguccuuuuaacaugcagcuuggacacagcauugggauauuugucgaaggcaaaagauaucuacaacagcauuuuaggccccuauuugggugacauuuggagacagcuggagauuguacaguuuauuagggggaaaaagccugaaaccaacuacaagauacaagaauugcaaugucagauacuaaguuggaugcaaagucaacagcaaauuaagguacugauuauaauaagaauggacucagacggugaaaaacauuuucucauuaaaauucuuaacaaaauagaagguuuaacacugacuguccuucauucaaaugaaagaaaagauuuucuggaaucugaagguguuuuaagggguacaaguuccuguguaguuguacauaaucaauauauuggagcagauuuccccuggaguaauuucucauuugugguggaauacaauuauguggaagacucuuguuggacuaaacacugcaaagaguugaauauuccuuacauggccuuuaaagugauucuuccagacacaguuuuagaaagaagcaccuugcuggauagauuuggagguuuucuuuuggaaauucagauuccauauguguuuuuugcaucugaaggacuucuuaauacuccagacauacuucagcugcuagaauccaacuauaacaucucacuaguagagagaggcugcagugagucauugaaacucuuuggaaguucagaguguuauguaguggugacaauugaugaacacacugccauaauuuugcaggaucuagaagaauugaauuaugagaaggcaucagacaauaucauuaugaggcugauggcauuaucauuacaguacagauauuguuggauaauuuuauauaccaaagaaacauuaaauucagaguaucugcuuacagaaaagacacuucaucaccuagcacugauuuaugcagcuuugguuucauuugggcuaaacucugaagaacuggauguaaagcuuauaauugccccaggaguagaagcaacugccuugauaauucgacaaauugcugaccacaguuuaaugaccucaaagagagauccucaugaaugguuggauaaauccuggcuuaaaguuucaccaucugaggaagaaauguacuuacuugauuuuccauguauuaacccauugguggcucagcucaugcuaaauaaaggaccuucacugcauuggauauuauuagcaacucugugucaacuucaggaacuccuaccugaagucccagaaaaaguguuaaagcauuuuuguagcaucacuucccuauucaagauugguucuucuuccauaacaaaaucaccgcaaauuucgucaccucaggaaaauaggaaucagauuaguaccuugucuucucaaaguucagcuucugauuuagacucugucauucaagaacauaaugaauauuaucaguauuuaggauuaggagagacagugcaggaagacaaaaccaccauuuugaaugacaacucuuccauuauggaacuaaaagaaaucucaaguuuuuuaccaccugugacuucauacaaucagaccagcuacuggaaagacuccagcuguaaaucuaauauagggcagaauacuccuuuucuaauuaauauagaaucaaggagaccggcuuauaacuccuuucuaaaccacagugauucagagucagaugucuuuucuuugggucuaacacaaaugaacugugaaacuauaaaaucaccaacugacacucagaagagagugucaguugucccccguuuuauaaauucucagaaaaggagaacacaugaagcaaaagguuucauaaauaaagauguaucggacccuaucuuuucacuagagggcacucaaucuccucuucauuggaacuuuaagaaaaauauaugggaacaagagaaucacccguucaacuuacaauauggugcacagcagacugcauguaacaaauuguacucucagaaagguaauuuauucacugaucagcaaaaaugucuaucagaugagucugaaggccucacaugugaaaguucaaaagaugagacuuucuggagagaauuaccaucuguccccaguuuggauuuauuucgugcuucugauucuaaugcaaaucaaaaagaauucaacagccuuuauuucuaccaaagagcuggaaaaaguuuaggacagaaaaggcaccaugaaucuucauuuaacucaggagacaaggaaucauuaacagguuuuaugugcucacaacuaccacaauucaaaaaacgacgucuagcauaugaaaaagucccugguagaguugaugggcagacucggcugagguuuuuuugaaggaggagaagagcaauguuacaugccauauuccacuguuuuugaugcuaauccacuagcgcaauuauuuagauuugcucauacacuaaagaaaacacaauuguucauauaugucucaguauuucuguauuaaauauucauaauauguauucugcccuaugguuugcaucuuuguaaguuaaauauucuaauuuaucaauuagcagaauaauuaucauaagauccaaaaugucuuccagacaccccugcacacaggccauuuaaaugagucuccaucacagucugacccuuugagucaggaagugaagaucaucacaguuaacccucccacaucaagaaaguuaaaaccuaggacaaaauugaaguuagaaaacuuccaacuuaaaguaucauuuucuguaaacacaauuuaagaacaaauuacuaagaggaaauauuugcaacccagauaauaggaaaaaaaguuuacauuucucauauauaaagaauuccuacaaauugauagaaagaagacaaccugauagaagaacgggcaaaauauaugaacagauauuuccucagaaaaaaacaaaaauugucaauaaacauuugaaacac

SEQ ID NO: 1420 - RNA, 111 nt, Homo Sapiens
uuauaaguuuucuaagugucuaaugaugaauuucauagggcagauucugaggugaaaauuuaauucaucacugauacuccuacuguggaaucugaagacacuugaaaacgu

SEQ ID NO: 1421 - RNA, 79 nt, Homo Sapiens
ugcaugaguucgucuuggucuaggauuguuggaggagucagaaaaacuaccccagggauccugaaguccuuugggugga

SEQ ID NO: 1422 - RNA, 3889 nt, Homo Sapiens
ggggccugccgaggccgccaaagcgggcugggcgggaggggccaggccagcuggggccggagcucgugugacaucaccgggcggcccgccucugucuggggcugaggggaggcccggagccuuucuggggccugggggauccucuugcacugguggguggagagaagcgccugcagccaaccagggucaggcugugcucacaguuuccucuggcggcauguaaaggcuccacaaaggaguugggaguucaaaugaggcugcugcggacggccugaggauggaccccaagcccuggaccugccgagcguggcacugaggcagcggcugacgcuacugugagggaaagaagguugugagcagccccgcaggaccccuggccagcccuggccccagccucugccggagcccucuguggaggcagagccaguggagcccagugaggcagggcugcuuggcagccaccggccugcaacucaggaaccccuccagaggccauggacaggcugccccgcugacggccagggugaagcaugugaggagccgccccggagccaagcaggagggaagaggcuuucauagauucuauucacaaagaauaaccaccauuuugcaaggaccaugaggccacugugcgugacaugcugguggcucggacugcuggcugccaugggagcuguugcaggccaggaggacgguuuugagggcacugaggagggcucgccaagagaguucauuuaccuaaacagguacaagcgggcgggcgagucccaggacaagugcaccuacaccuucauugugccccagcagcgggucacgggugccaucugcgucaacuccaaggagccugaggugcuucuggagaaccgagugcauaagcaggagcuagagcugcucaacaaugagcugcucaagcagaagcggcagaucgagacgcugcagcagcugguggagguggacggcggcauugugagcgaggugaagcugcugcgcaaggagagccgcaacaugaacucgcgggucacgcagcucuacaugcagcuccugcacgagaucauccgcaagcgggacaacgcguuggagcucucccagcuggagaacaggauccugaaccagacagccgacaugcugcagcuggccagcaaguacaaggaccuggagcacaaguaccagcaccuggccacacuggcccacaaccaaucagagaucaucgcgcagcuugaggagcacugccagagggugcccucggccaggcccgucccccagccaccccccgcugccccgccccgggucuaccaaccacccaccuacaaccgcaucaucaaccagaucucuaccaacgagauccagagugaccagaaccugaaggugcugccacccccucugcccacuaugcccacucucaccagccucccaucuuccaccgacaagccgucgggacucuaggaaucaucauuucuggaagaagcaggccagaggcuccccugucagaaugucagcacacauccaguccccugaagcucagccccuuguucauccagaacaccugagccuucccagugggcugccauaugagaacuauauucaucucugcauaaaugaaccauguaucuacuccaagcccauggagagacugccugcaggcccuggaggauggccacgacaccagcuccaucuaccuggugaagccggagaacaccaaccgccucaugcagguguggugcgaccagagacacgaccccgggggcuggaccgucauccagagacgccuggauggcucuguuaacuucuucaggaacugggagacguacaagcaaggguuugggaacauugacggcgaauacuggcugggccuggagaacauuuacuggcugacgaaccaaggcaacuacaaacuccuggugaccauggaggacugguccggccgcaaagucuuugcagaauacgccaguuuccgccuggaaccugagagcgaguauuauaagcugcggcuggggcgcuaccauggcaaugcgggugacuccuuuacauggcacaacggcaagcaguucaccacccuggacagagaucaugaugucuacacaggaaacugugcccacuaccagaagggaggcuggugguauaacgccugugcccacuccaaccucaacggggucugguaccgcgggggccauuaccggagccgcuaccaggacggagucuacugggcugaguuccgaggaggcucuuacucacucaagaaaguggugaugaugauccgaccgaaccccaacaccuuccacuaagccagcucccccuccugaccucucguggccauugccaggagcccacccuggucacgcuggccacagcacaaagaacaacuccucaccaguucauccugaggcugggaggaccgggaugcuggauucuguuuuccgaagucacugcagcggaugauggaacugaaucgauacgguguuuucugucccuccuacuuuccuucacaccagacagccccucaugucuccaggacaggacaggacuacagacaacucuuucuuuaaauaaauuaagucucuacaauaaaaacacaacugcaaaguaccuucauaauauacauguguaugagccucccuugugcacguauguguauaccacauauauaugcauuuagauauacaucacaugugauauaucuagauccauauauagguuugccuuagauaccuaaauacacauauauucaguucucagauguugaagcugucaccagcagcuuugcucuuaggagaaaagcauuucauuaguguuguauuacuugagucuaaggguagaucacagacuguguggucucaacugaaaggaucacccuuggcaucugugugccuggauucuuccagaaugucuacaaugcuaaucucucacauagagguucccagcuucuuaagaaccccuuuuggcaccuaaucaaauuucaaaaucccuccccccacauuuucauacuuuuccccauucucaggacuuuucaccauccaucacccacuuaucccuucauuugacaccauucauuaagugccuucugugugucagucccuggccacucacugcaguucaaggcccccuuuccgcucugcuguacuccucgccuaccuacuccuugccuuuucugucgcacagccccuucuuuccaggcgagauuccucagcuucugaguaggaaacacuccgggcuccagguuucugguugggaagggaaggccaggccaaaagcuccaccggccguauagauaauguacucgcaguuuuguaucuuccauucauacuuuaaccuacaggucauuugagucuucacacaaauaauaaccuaucuggccaggagaauuaucucagaacagaagucaucagaucaucagagcccccagauggcuacagaccagagauuccacgcucucaggcugacuagaguccgcaucucaucuccaaacuacacuucccuggagaacaagugccacaaaaaugaaaacaggccacuucucaggaguugaauaaucaggggucaccggaccccuugguugaugcacugcagcaugguggcuuucugaguccuguuggccaccaagugucagccucagcacucccgggacuauugccaagaaggggcaagggaugagucaagaaggugagacccuucccggugggcacgugggccaggcugugugagauguuggauguuugguacuguccaugucugggugugugccuauuaccucagcauuucucacaaaguguaccauguagcauguuuuguguauauaaaagggaggguuuuuuuaaaaauauauucccagauuauccuuguaaugacacgaaucugcaauaaaagccaucagugcuauuuggauguaucuaca

SEQ ID NO: 1423 - RNA, 6120 nt, Homo Sapiens
agucucaccgguccgcccggccgcgcggcgugagcuccccggacaucgcgucucgggaugcugcaagccagcgcggccgcucgcgcgcagccccgcaccuccgccccugccucugccuccugggccaugcccugcuguuuacaugccggugagguccccggccgcuccgaaccccuccgagccccggcuccccgagggugaagcccgccggcccgcgaacuggacugguggaucucucagaccuggggccccggacuccgaucuccgccgucuccgccaccaucagggcgggauccggcucugguguuuugaggagggggugugguguagggaaaggaaucccgucccucuccaccuuuuuucgccuucggggcuucagacucagggaacucgcucauggcuuucuugaugaagaagaagaaauucaaauuccaaacuacuuucacccuggaggagcugacugcgguucccuucgugaacgggguccucuucugcaagguccggcugcuggauggaggggauuuugucagcuugucgucaaggccugcaggagacauuuccauccugcuucugcuacuugcugccugugugaccuugggcaagggacugucccgguccgauuugggauacagggaggagguacaggagaacugugugcgguggcgaaagagguucaccuucguguguaagaugagugcuaacccggccaccggccugcuggaccccugugucuuccgugugucugugcgcaaggagcugaaaggcgggaaggcuuauuccaagguaagaggggcugugugaaggggcagugggauggaaugggggguggcaugggacaggcacaagggaagccuccagccccuuuucugccacaagcaagaggcacucagcccuaccugagauguguuauuuuuuagaaauaucuuuauugauggucuuugcacucaauauaaaggcagcauaugguuguugcaauauaaaugguacagaaguccacagagcaaaagggccaguuucuguccccuuuccucucuccaggccucuuucugggaccccauuauuggauagauuaagaccuuuccagaccuugcugccgacccggggccucuguccuugggucccaguuaugcaacagucagucgaggcuguggggcuggcccaggggcuuuaucugucucccucuccaacuuuugccaaguuacccuucugggcuuccgccagccaggagcccacacucccucagcccucccacacgcuccucucaccuccuagcugggcuucgcugacuugaaccuggccgaguuugcgggcucgggcuccacggugcgcugcugccugcucgagggauaugacacgaagaacacucgccaggacaacuccauccuuaaggucaccauugguauguuccugcucucuggagaucccugcuucaagacgccaccaucgacugccaaguccaucuccaucccaggccaggauuccucccugcagcugacguguaaggguggugggaccagcagugggggcagcagcaccaacucccugacugggucccggccccccaaggcucggcccacuauucucagcucagggcugccagaggaacccgaccagaaccuguccagcccugaggagguguuccacucuggccacucccgcaacuccagcuaugccagccagcaguccaagaucuccggcuacagcacagagcacucgcgcuccuccagccucucagaccugacgcaccgccgcaacacguccaccagcagcagcgccucugggggccuuggcaugaccguggagggcccugagggcagugagcgggagcaccggcccccggagaagccgccgcggccaccccggccccugcaucuguccgaucgcucuuucaggcggaagaaggacucgguggagagccacccgaccuggguggacgacacgcggaucgaugcggaugccaucguggagaagaucgugcagagccaggauuucacagauggcagcaacaccgaggacagcaaccuccggcuguucgugagccgcgauggcucugccacgcugagcggcauccagcuugccaccagguagggcaggcuuagggaggggucgucggggcggcuggggcuugggggugagagcagaguccccacaguccacucaccuggccuugaacgccaaaucuugucgccacagugugacccugggccugucaugucucugaaccucccuuuccccaucugucaggcuguguggacaccaccaccucaccugggagccuggggcagugagggcacggacagguucggugguuucccacaguucacaaggucaccuccagcaaugccuggugcagggcucagcacauggcaggggccucacacgcauuuauuuagaacccucccuucuacuuccucccagcuccagggacucgggaagaauggugguggugaugccucauggguuuacugaacaaaucuuucccuagcaccagcuaggcacuaggcccuaagugaaggccugguucaaugcaggcugcugccuacacagcauccacagauggcagggguagaugggaccaaaguugcgggaacgacaguuuauagagugcugcgucacagacauucauuuggagcauguugacuaugugccuggcucuccaugugcuuuggcuaaccaaaugaaugagcgagugagcgaaugagcuucccacaggcgggcugcugagggcagguggggagcccgccuaacauccacauccccagggaagaggcguggccaggccgcugcgcagaggcuacccucucaagcugcucugcugacuccugcuggccacggccuggaauggcagcuaucaccucccaguagccuccugggcugcucucgggugggggugagggggcggugagcaagaaggaaacugaggggcuggcuuccuuauggguuuguaaacacaccccucccuggcccccucugaaaaugaggaagcaucuuggggaaagaaaccaaucugguugggagcgagaucacagcagagcuacaugcugagccccgagaguccccgacuccagggcugggccugggcucggcagggaaaggagcugaccagguuuccugacuucccacugcccucuuggucacccucacaucccucugagccucaguuucuucaccugucaaguggggcaggaugcagugacucccugccgaggugaccgugaggaugggguggcacagccagaugugcccggaagggcucugcaggccccacagacucugaugcuuacuaucugugucacugugggcaagggacuuaccaucgcuggggcacgguuuuagccccuuugcaacacagggcugguuaacaguaccugcuugugaaacaccuccagaggccugguccaguggagcgcucaggaaaugggguaucgagggggacaugcugaccugucucucaccugcagggucucuucuggggucuacgagccaguugugauugaaagccauugaggagcagguguccgggcuggagaagaguccugcuuucucuggaguccagaccuguaucauuccaugaggaacuuuccccuucagaucaccucugcgccacaucucauccaugccuccuccaugcacuccaguccacacuccccguagcaucauuccauugccccucccauccaugcugggacccuccuggcccaccaaggcccaggcaccacugugaauauucuccucugaaccacuagagggcaggccaggcaggccaggcgggcccgugcagcuugugggcaagaaggagcuggcaaggaccggcgcugcuggagacugacccagcccucuggcugaggacaugcagcggcuccuaaauguagagaugccuguggcugagggggccucucuaccuguguccccacucacuccaggagcacuggcuuuggucacgucuuagcagcagggccuugcuccguuguucccuugcccugguggugggggggccagaccaccuccggaauccugccaccugugacugucugacugcuuagugcuucagcugucccuuccuuguguccugggggaccugcuggcggccucuuccugggagccaugaccucagaccccacccacacuccagaucgagaccccugccuccccccggcaaauguccucccgcugccuugcagccugcacuuugcacaugcucacccccagcacagucccacuggccccucaccuccccuucccugagcuccuucccaaggacuccuggucacugccugcugugcagucagaggcccaggguccagcagcccggcgggaacgggugcugccucuuccuccaguuagcuccagcucaggucugagacccgugcugagaaaggucugagcaccgaccgugcccucugcccagggcuggguccugagcagcugguuuuccugcaggaagguuggagcaagcaaaguccuucucugcccucagggucagcugcccagacuggggcggaugccagagaggcaggugggcuguggcuggacugguccggagcuggcuuccuuaccagaaaagccucagccuuccucuggaagcaucccccguucugggcaagggggaagggcuccuuuaaggggugugcuuucccaguggggagcagucuggcccugcccccuacuaaagccucugcucucagcacuuucccccaaguccuuguaacuugcuugaagguggguucuggcugccagccagucccuggacaaacucuccugccccuuuuaaauuucacucauuuuguauaaacccagcaggcugguguuuacuuagcccuguagcuuuuuucauuuuuucuuuccgucuuucuucuugaguucacgguucaauauugccuccucgcccuggugaggggaggugcugcuuuucugccccaccugccggcugguuccagcagcgcuggggcccagcuggggggccgggaugggggcuucucucucugggaggggugcaggugcccuccccaggcugggaggguuccuucccuagcuccccaucugcccccgcuggugagaguugggcuucuuggucuuggaacucccuggcauugggaacagagcauuuccagcauuuguuguuguuuuacucaccuaacccuuagaaaaugaauguuagaaggugccugccgaggcgggacagaguguucgcucgcgcuggagaaggcucugcucagcccugagagucccuuccugccccaccgauacuggcacuuuaaaaaggaagcugaccgcacaguguccagacgaauuggcccccagaagauggggaguucuguccugcccuucugugucugcgugaccucacccagccuaggagggaggugcauucaggguagauuugccucucauucaaaguucuggggcuuuggguggaaaacagccagcuuuggcgcuguuggggagacuccuccagaccaggaaccccagaaggagacagagccugccacauccucccacgccaggcccugggccagggugauuggacugagaauuuggccacaaccaaauugaugcuggcuggaaccagaggccagaaagccuggccuuguccccaugugggagcccuguccucagcccucuuguccccuugagcucagugaauucccaccaggugcccacagcuccuggacuucaaauucuauauauugagagaguuggagaguauaucagagauauuuuuggaaaggaguuggucuaugcaaugucaguuuggaaucuucuugaaaguuuaauguuuuuauuaggagauuuaaagaaaauaaaggucuacaauaucuuuagguuuuuuuuuuuuccuguuuaccgcacaaacugaccacauggcaugucuaucaggauggaggguguccauguucuccucugucuuuagggaggugauaaggagaugggcggagggguguuuuuuucuuugacuccccuccuuucuaacagaauguugccaccacugcuugagugggcuguguuuguuccucugucccagcuucuguuguagaaaauaacauuguuaggggaacucaggcuagugucagcgucuugguuuggggagaaaaaauuaaauguuucgguuuuuguuucuuu

SEQ ID NO: 1424 - RNA, 5692 nt, Homo Sapiens
accgccucccccucccacccuucucugucuaccucugggcgggacugccgggugaugagauacucggucggcgacgguagaacgggcgacggcgacaaccgcaaucacauccacgacggugaucauggcagagaaucacgcccagaauaaagccaagcucaucucugagacccggaggagguucgaagcugaguaugugacagguggguacucuguuccagguauuaagaaaggugugcagugagcauccccaacuuugcuggaguguuugugaguguauuugugggagguguuagggacccuuucgacccucacaggaaugaugcugggcacgucucaaagguuuuccucuccaugacaagccgugugcacugcuucaaauggucaaguggugugucccaugcucccuuuaaaggguuaauguaaguuggaaaucgguuaaguuuuuagcaugcccucguguuuauggaacuugcaggauacuuguuaggcccacaacacgggugacauuguccaguccacgguuccacugcuggccuuucaccagcaacacuagcgaaaauguaccuggaaacugccauaauacuauugauguguacuuaauuggguauacaaauuccuuggauauuuuguuugauuuggcuuucauacaacccagcaugcuacccacaaaauaggcccuccaaugcuggaacaaguucuuaucccaaacuguaucuugcaaaguaccuaugaguccagaauugauuuauugguugaacauucuguguccagaugucacagauacuugaguugucagguacuuaacugaauauuuaaugcuuguacaguaauuuuguaaaacauacggaauaacuuauuguaaauauggaauuaaauaaggauuuauauguugccuaagucacaauaauagguacuuaaaaacaugucauaugauaggaaacuagaauaacacaccucuaaauaauccauggauuaccaacuucucagcaaugguguaaauucuucugcuaaauaacccguggguuaaagaggacaucacauuggaaauuccagaguacuuaaaauaagucagauaaauaugaugcacgugauguugaaaggcuacaacaagaugauaacuggguugaaaguuacuuaucuuggagacauaauauuguagaugaaacacugaagaugcucgaugagaguuuucaguggaggaaagaaauuucugucaaugguaagcuguucaauuuaaccuugacuguaauauauacuguauaaaugguauuguuuuacauuuaucuaaucauguauuugcacauauuccuagcagucaucauaaacaccagaauauaauuauuuauaaagacccaguaauauuuucaaaggaacagcuuauaagucuuuuaagugggaucauucauaaggaaaucagaucaccagagagcagaaucacacucagauucuucauucacagcagaguuuccuaaucuguguuuaauucaguaccauuaagcaauagcaagacaguaucuuugcuacuaggccuagaaauaaggagauacuguccauuuuucucaguuguugccuaugccuuucucuguccccacaguuccuugugcuaauagguuaauagguacgccauauagaauuguuaaaugaaugagagucaccccaaaaaugcaagcuuauccccaaggaagccuaucacaaccuuaaugaauccuccauucccagaugguuauuggaaauugguguuauuuaucuccaugguuaugacaaagaagguaacaaauuguucuggaucagggugaaguaucauguaaaagaccagaaaaccauauuggacaaaaagaagcucauagcauucugguuggaacguuaugcuaagagggaaaaugggaaaccuguaacagugauguuugaccugucagaaacuggaauaaauagcauugacauggacuuuguacgcuuuaucaucaacugcuuuaagguuuauuacccuaaauaccucucaaaaauagugaucuuugauaugccuugguuaaugaaugcugcuuucaaaauugugaaaaccuggcuugguccagaagcagugagcuuguugaaguuuacaagcaaaaaugaaguccaggacuaugucaguguagaauaccugccuccccacauggguggaacugauccuuucaaguauagcuauccaccacuaguagaugaugacuuccagaccccacugugugagaaugggccuauuaccagugaggaugaaacuucaaguaaagaagacauagaaagugauggcaaagaaacauuggaaacaauuucuaaugaagaacaaacaccucuucuuaaaaagauuaacccaaccgaaucuacuuccaaagcagaagaaaaugaaaaaguugauucaaaagugaaagcuuucaagaaaccauugaguguauuuaaaggccccuuacuacacaucagcccagcagaagaacuguacuuuggaaguacagaauccggagagaagaaaaccuuaauaguguugacaaauguaacuaaaaauauaguggcauuuaagggagauauaccuaaugcuaaaugacgaguuaaugggugcagcacaccaacauggcacauguauacauauguaacaaaccugcacguugugcacauguacccuaaaacuuaaaguauaauaaaaauaaaaaaaauaaaaauaaaaauaaaaauaaagugagaacaacagcuccagaaaaauacagagucaagccaagcaauagcagcugugacccgggugcaucaguggauauaguugugucuccccauggggguuuaacagucucugcccaagaccguuuucugauaauggcugcagaaauggaacagucaucuggcacaggcccagcagaauuaacucaguuuuggaaagaaguucccagaaacaaagugauggaacauagguuaagaugccauacuguugaaagcaguaaaccaaacacucuuacguuaaaagacaaugcuuucaauaugucagauaaaaccagugaagauauaugucuacaacucagucguuuacuagaaagcaauaggaagcuugaagaccaaguucagcguuguaucugguuccagcagcugcugcuuuccuuaacaaugcucuugcuugcuuuugucaccucuuucuucuauuuauuguacaguuaaagaaguggugccggguaggaaccacgguuccuucguccauuaguuggaaaaaguaacagaccuaaaacucuaccaagcuacuaaaaacauugcacaucugugcuuccuaaaaggaaauaugcagcacguggaggggaacacauacaugucuugaaaauaaacugcuagaauaaagaaaugcuggagaaauugauuauaagagacuauagcuauuuaguaaaguaaguaaaggcauauccauuguguaaauuaauaguuuaaauauaauuuauuuuuuccuuuugaucugaauacuuuuaaagcuuaaguuuuaucguguaaauacauuagcuaaacugaaaaguauaaguaacaugcuuuguugcagccaaaaaauguaaucugcuuuuuuaugacagaauuauuauagcugagcugacuuacuagcuuuucuauacuauguauauagaagaacauguauauugagaaagaaaacauacuuauauagaggaauuuauguaaccaugacuuuguaauuuugagaauuccucccagugauggucaguauucuuuuggaauguaaaccgauuuaaugccaaaccaccuuaaccuuuguuucucaguguuccuuaacagccugccuuuuauuaaucucaggcuuuuuuaugaacacucucauuucaguagaauuuggaaaacuaagcgugguuggaauuucuuugaauucuguuaguaaugcccaaaagaaaagucucaagcagucccccuauccagucauuuuuauggaguuucauguuguccacuauagcuggacacugaaccuuuugccuaauuuauuauaaaggccugacccucuauugucccaucuucacccccauuccagagcagaggagucucuguggaccaugaauugcacugucucccuccucauuucuaaaugaaagguauuagauauaaauuuuuuugaaagguuaguuguuugagaugcuaagcaggauaauaaauuuagauuuuaaaauguucccuguaaaagucagcccaugacaaggaaauuuacaaaauacuagaguaucuagaagggugaaaacaaaaaaaaauaaaaagaaacacagacgcccaggugucagcucuccguuuaaagaaugaaaaauguaacucaugaugaucugugaaaccuucaaacuaggaccaauugacuuacuugauauucugccuuugauaugguaguacccacccgguauuccuaaaauccuaaaaagauacaccuugcaguagcagaggcaaugacaugaguuuguuuucucauuaauaugaccaguuugggucuauguugguucacauguacaucuacuuuauaugaaagaaaaaacaguugucugccuguaaaauguugaguuucgauugagccauguuuggagauuuuauuacuauucugaaggguaguguuguugguuuucaucuucaagaaguugauuccaaaacugaguuaugaagaaugauauaacaguuccuucaaaauuggccuaggaaauaaaaccuuaaaaggacacuggugugcuacuuugucuuaauuugggcuuuucuguuucaguuugccaccuccagcugugaaauggacugcaguccacccuaaguacugugcacaguaucucccugugugugugcacaguggcuuccccuuacaugguagauuuuuggccuuaauauaaucuaaucccaaaguaguuguguauguuuucuguuccuuggcaaauaaaugaagaaauaauuagccaagauugaaaauguauuguccuaacggugucccuuuaauguuucauaugaaaaauuauguugacccacuaaaauauccuugcucaaugucuggucaguugaauuuaauaacauaucuuguuaauguuugugugucuauuaaaugugacuaagcaggauuacugaaaauucacuauaaaaucaaaggcaucuaaacguuuguacuugucuugauuaaucauauauuuacacuugauuuuuuucugucuucauuuguuuuuauuuaaucauaauugcaugauuuuuuugguacucuaaucaguaauuuuauuuuuaaucaugucauuaccuauucaugaccaaauuaccaaggaaccaacauuuagauuuagauauuuguuuucacuuaggaauggaaauuaauagauuuuccaugaaagcauuagugaaauaucauuaccuugaucugcaaguagccuaaaaaugcgauugcugguaaaccuggccucaaauuucauacuaccauaacuguuuuuauauauugccacuaauuuugacuggauuuaauagcacuuuauuguacaacuacaaaaaaaaauauauuccuagaauuguugccaguguaauuucucuaauguucuggugcuuuucauauauuuucaguauuuuuauuacuauauugguauuuucuuuguauaaauugauugauuaaaagaacauguuuucuauuuuaauauguuuuagaaaaauaauuacauuuaugaaauaaauaucaucaggaaaaaaa

SEQ ID NO: 1425 - RNA, 2864 nt, Homo Sapiens
augaacauacaucacaaugugaacaguggucaucuccagauaguagaauuucagauauguuucuuuccauuuuucugacaguuugaauuuucuguaauaauuaauugacuuuuauacaauggaaacaacuuuuuuguuuuggaaaaaagaaagaugcugccgcuaaucaguggaugaaaaauaaacguguugggggcacugaguaauguagccauuucugacccggcagccaggaaaaugugaaacaauuugcuucuggaaacaggacagccggggccguguuccugcaacagcagaccaagcaccgcggcggacccaggcaagcacggaacaagcugagacggggaauaugagugauggugccucaaagcaguaacuuuuugcuuagagcuugagagucaaaguuaaggacccacauguauacuucggcucuagcgagucuaaggaugauaauauggauacaaaaucuauucuagaagaacuucuucucaaaagaucacagcaaaagaagaaaaugucaccaaauaauuacaaagaacggcuuuuuguuuugaccaaaacaaaccuuuccuacuaugaauaugacaaaaugaaaaggggcagcagaaaaggauccauugaaauuaagaaaaucagauguguggagaaaguaaaucucgaggagcagacgccuguagagagacaguacccauuucagauugucuauaaagaugggcuucucuaugucuaugcaucaaaugaagagagccgaagucagugguugaaagcauuacaaaaagagauaagggguaacccccaccugcuggucaaguaccauaguggguucuucguggacgggaaguuccuguguugccagcagagcuguaaagcagccccaggauguacccucugggaagcauaugcuaaucugcauacugcagucaaugaagagaaacacagaguucccaccuucccagacagagugcugaagauaccucgggcaguuccuguucucaaaauggaugcaccaucuucaaguaccacucuagcccaauaugacaacgaaucaaagaaaaacuauggcucccagccaccaucuucaaguaccagucuagcgcaauaugacagcaacucaaagaaaaucuauggcucccagccaaacuucaacaugcaguauauuccaagggaagacuucccugacugguggcaaguaagaaaacugaaaaguagcagcagcagugaagauguugcaagcaguaaccaaaaagaaagaaaugugaaucacaccaccucaaagauuucaugggaauucccugagucaaguucaucugaagaagaggaaaaccuggaugauuaugacugguuugcugguaacaucuccagaucacaaucugaacaguuacucagacaaaagggaaaagaaggagcauuuaugguuagaaauucgagccaagugggaauguacacaguguccuuauuuaguaaggcugugaaugauaaaaaaggaacugucaaacauuaccacgugcauacaaaugcugagaacaaauuauaccuggcagaaaacuacuguuuugauuccauuccaaagcuuauucauuaucaucaacacaauucagcaggcaugaucacacggcuccgccacccugugucaacaaaggccaacaagguccccgacucugugucccugggaaauggaaucugggaacugaaaagagaagagauuaccuuguugaaggagcugggaaguggccaguuuggagugguccagcugggcaaguggaaggggcaguaugauguugcuguuaagaugaucaaggagggcuccaugucagaagaugaauucuuucaggaggcccagacuaugaugaaacucagccaucccaagcugguuaaauucuauggaguguguucaaaggaauaccccauauacauagugacugaauauauaagcaauggcugcuugcugaauuaccugaggagucacggaaaaggacuugaaccuucccagcucuuagaaaugugcuacgaugucugugaaggcauggccuucuuggagagucaccaauucauacaccgggacuuggcugcucguaacugcuugguggacagagaucucugugugaaaguaucugacuuuggaaugacaagguauguucuugaugaccaguaugucaguucagucggaacaaaguuuccagucaaguggucagcuccagagguguuucauuacuucaaauacagcagcaagucagacguaugggcauuugggauccugaugugggagguguucagccuggggaagcagcccuaugacuuguaugacaacucccaggugguucugaaggucucccagggccacaggcuuuaccggccccaccuggcaucggacaccaucuaccagaucauguacagcugcuggcacgagcuuccagaaaagcgucccacauuucagcaacuccugucuuccauugaaccacuucgggaaaaagacaagcauugaagaagaaauuaggagugcugauaagaaugaauauagaugcuggccagcauuuucauucauuuuaaggaaaguagcaaggcauaauguaauuuagcuaguuuuuaauaguguucucuguauugucuauuauuuagaaaugaacaaggcaggaaacaaaagauucccuugaaauuuagaucaaauuaguaauuuuguuuaugcugcuccugauauaacacuuuccagccuauagcagaagcacauuuucagacugcaauauagagacuguguucauguguaaagacugagcagaacugaaaaauuacuuauuggauauucauucuuuucuuuauauugucauugucacaacaauuaaauauacuaccaaguacagaaaugugga

SEQ ID NO: 1426 - RNA, 1612 nt, Homo Sapiens
uccugacuuccgcuuuggaggcgaggacccgagcgaguguagggggugcggcgucuggucagccaggggugaauucucaggacuggucggcagucaagccaucaugccucguggucagaagaguaagcuccgugcccgugagaaacgccgcaaggcccgagaugagacccggggucucaauguuccucaggucacugaagcagaggaagaagaggcccccugcuguuccucuucuguuucugggggugcugcuucaagcucuccugcugcuggcauuccccaggagccucagagagccccaaccacugccgcugcugcggcugcggguguuucauccacaaaaucuaaaaaaggugccaagagccaccaaggugagaaaaaugcaaguuccucccaggccucaacauccacuaagagcccaagcgaagauccucuaaccaggaagucagggucguuggugcaguuccuguuguacaaguauaaaauaaaaaaguccguuacaaagggagaaaugcugaaaauuguuggcaaaagguucagggagcacuucccugagauccucaagaaagccucugagggccucaguguugucuuuggccuugagcugaauaaagucaaccccaacggccacacuuacaccuucaucgacaagguagaccucacugaugaggaaucccugcucaguuccugggacuuucccaggagaaagcuucugaugccucuccugggugugaucuucuuaaauggcaacucagcuacugaggaagagaucugggaauuccugaauauguugggagucuaugauggagaggagcacucagucuuuggggaacccuggaagcucaucaccaaagaucuggugcaggaaaaauaucuggaguacaagcaggugcccagcagugaucccccacgcuuucaauuccugugggguccgagagccuaugcugaaaccagcaagaugaaaguccuggaguuuuuggccaagguaaaugguaccacccccugugccuucccaacccauuacgaagaagcuuugaaagaugaagagaaagccggagucugagccagaguuguagccaggccuugcacuacugccauagccaaucaaucucccaaagccaaguuuaccugcuguucucacccccaaugaggucuuaggcagauucuuuacuuuguaauucaaaaggccuguuaaccuuuguucuuguuaugcaugaauaacuuguugacuuuuuuuuuuucucuuuuucaacuaguguuucaacagguuuauuuagauucagaauguaaauuuacaaaugauauagaucacccuguuauugcuguuuuucagggacaguagaaaguguuuuguuuuuugagugaaacaacuuauuaauaaaaauccuuaaaucacuuuuguaauccaggacaagaaaauguggcauuagaguagaaauaucuuuggaaaugugaaagaccccauagugaaauauuugggaucagaagccagagguguaaaaguggucaauucuugguuuacuucauuuaaucuuucuuuucauaaagauacauaccuggauuuguuuauguuauucaagaaugugugagaaauuaaaccauaguuaguuaa

SEQ ID NO: 1427 - RNA, 245 nt, Homo Sapiens
uguuuuuguuuuuuuugagacagggucuuguucugcuguccaggcuggaguacaguggcacaauaauggcucacugcagccuugaucuccugggcucaagugauccuccugccucagccucccaaguauccaagacuacaggaaccaaagaaagaucuugcauuuucuaaugaauucugagcccacaguacaacucaucuuuggaaaucacugcuccagaauccaaagcauggugcucagguacu

SEQ ID NO: 1428 - RNA, 103 nt, Homo Sapiens
gucuaaaauuggaacauauacuaaaauuggaacaauacagagaagauuagcauggcuccuguguaaggaugacgugcaaauuugucaaggguuucauuuuuuu

SEQ ID NO: 1429 - RNA, 3141 nt, Homo Sapiens
acugggcgucuucugcccggccccuucgcccacgugaagaacgccagggagcugugaggcagugcugugugguuccugccguccggacucuuuuuccucuacugagauucaucugugugaaauaugaguuggcgaggaagaucgaccuauuauuggccuagaccaaggcgcuauguacagccuccugaaaugauugggccuaugcggcccgagcaguucagugaugaaguggaaccagcaacaccugaagaaggggaaccagcaacucaacgucaggauccugcagcugcucaggagggagaggaugagggagcaucugcaggucaagggccgaagccugaagcugauagccaggaacagggucacccacagacugggugugagugugaagaugguccugaugggcaggagauggacccgccaaauccagaggaggugaaaacgccugaagaagagaugaggucucacuauguugcccagacugggauucucuggcuuuuaaugaacaauugcuucuuaaaucuuuccccacggaaaccuugagugacugaaauaucaaauggcaagagaccguuuaguuccuaucaucuguggcaugugaagggcaaucacaguguuaaaagaagacaugcugaaauguugcaggcugcuccuauguuggaaaauucuucauugaaguucucccaauaaagcuuuacagccuucugcaaagaagucuugugaaucuuuugucaauuuuauuucuagcuauuugaugcugugaaauguuucauucuuugcaauuuuguauucuaucuccuugagcuguguguagaggcauaauucucauguauugauuuucuauccagcaaccuuguuaaauaugcuuaugaauuuuaaaaguuuacuucuagguuuuuucaguuuucaaccuacagaaucauaucauuuuugaauaagaacaauuuuguuucugccuuuuuuguuuguuuuuucuuuuguauuuuucguagaggugggauuuuggccuguguccuaggcuuuuuuugaacuccugagcgcaaguaauccacucuccuuggccuuucaaaguguugggauuacaggcaugggccaccgugcugguccuguuuuugccauuuuaaacccuuuuauuuccuuuucugauuuuauggcauugagcagaucuaccggauacaauugugauaguggaaauuuuuguguuauuccugaugagaaauggaaaaauuucaacauuucacgacaauauuuaguguacuuuuuuuguagauggacuuuuucagaguaagucaagccauucuguuuuaguuuguugagaguguucauuuugaauauauguugaauuucaucaaacacugaccugagucaucuuaaaacaugugaauugagauuucuuugcuacuaagaaagugagcgggcacucugcuucauguuuacuuuugucauguugcaugaaaaacauuuugcuucauguuugauucuguauguugaaaacugaaaucaucuauugugauuaccacaggguuuuuucccccaguaaucuguuuauguagucaauuacguugauaaaucuguacuuuuuaaauuuuaacaauugagacaggucucacucugucacccaugcugacugcaguagugugaucacagcuuacugcaaccucaaccuccugggcucaggcgauccucccaccucacccuccucaguagcuaggacuauagguacaugccaccaugccaagcuaauuuuucuguuuuagagaugguauuuuuucauguugcccaggcugguuuuauacuccuaaucucaagccauccacuagccucagccucccaaagugcugggauuacaggaaugagucacggugccuggaaauuuuguacauuuaaaccaacaauuuggucauggguaaucuauguccuaauaauuuauuuaaggauuuuuauguauauccucaugagugacauuaccuguacuuuuauuucauaugcucauuuguuggacguuguuaucaagguuccucuagcuucauaaaacggguugguauguaaaaccucuuuuuccauucacuggaacucaagucuccucaaggcugugaguaaugcagggcuaggcuuucccauaaugagcuuuucuagaaugcuucucucagauuuggacccuacuuaaacagcagugaccaaacgggcagcuccagguaccuauccccucaaacuuugugagggucgcguucucugaagaugccucuucaauuugaaagcuaucuguuccuguuucucugcugauauuaacucucugugcacagaaaguuaaacgucacugguuauuaauuucccuagauuuugaucugugcuguguggcugagaaugggcugacugacccuagaucuguguauaauuaugacaauggcuccauuuauuuuuaaaauaagaggaauuauuauaaaauuccuauuuacuggauguguacuaucuaugaauuacuucuuugugcuagguuguguacauguaugaccucuuuagauccucacaagauaaggcagaauuuucaugaaauugaugacugacuccaguaagaagcagauuuggggggauuucaauuucuaagcucaaagcccuugcacuuuucucaaaguaaagcuuuugaaaguguuaaauguacacgaacugaugguguauaugaugauuuuaguuguaaucugauguuuucuuuaaaaauuuacauauacaaaaguguuugacucaaaaggcuuuguucuucccuuaaaggaagcaucuaccaaaauguggcacacaaaccuugcauggugucucuagggccuccuaccccgcauuuccccugcuuuuucucuuguucugacugaaaaacaaagugcuuugacugugcugugacccagccagcugcauguuuacccagcaugcuugaacccaagcuggagccuugaacauaaagguguuuaaguuguugcucaaaauauggaaagaaucuagcucuggccuugaaccaaaucccuuaaacucuccuauaaaacuccauaaccugacccccucagugcggauauaccuaggcaugacauucuuguugccuguugcgaggaugcuuuagccuacucuaaguucucccaauaaaugcuuuggacugau

SEQ ID NO: 1430 - RNA, 131 nt, Homo Sapiens
ggggugugcucagagcagggggcccaaagaauggcuccucuguuuacaacacacccaacaggaaucuggggucauugugaugagggcgucaaacuuguggcuucccuaugaacaaacgucccccaacaccu

SEQ ID NO: 1431 - RNA, 3024 nt, Homo Sapiens
ucauuacggaucccggcugaaagccauuuuguuuuucagcucacuucaaggguaccugaagcgaauuggcaccaaagcagcagcuguauugccgcaguucuagcuucaccuucacgauguuucccuuggucaaaagcgcacuaaaucgucuccaagggacagagaauugcucuguuacccaggcuggaguguaguggugugaucauagcucacugcauccucuaacuccuggacucaagugaucguccggccacagccuccugaguagcugggacuacaguucgaagcauucagcaaacaauggcaaggcagagccaccagaaacguacaccugauuuucaugacaaauacgguaaugcuguauuagcuaguggagccacuuucuguauuguuacauggacauauguaaguacuauugauuaauaauuucuguuucagauguuuuucauucucagucuaugcauucaaagugucuuaacauaguaguguacauaucuaguuaggagggacuugagagauuguguaaucuaauuacccacacagugcaggggauuuuuuccccccagcauucauccaucuucuguucuuaacauucccaguaauaaauugcuuacuggaucacaaggcagcccuuuccaucuuguguagcuguuuuuuuuguuuuuguuuuuuuuuuuuuuuaagaagaagucuugcugugucccccaggcuggagugcaguggugcgaucuuggcucacugcaaccucugccuccuggguucaagcacuucuucugccucaggcucccaaguagcugggaccacaggugugugccaccaggccuggcuauuuuuguagcaacacaagucggaauagaauggaaccuguccccuguuggcagaguuaccccaaaggaauggaggaaucaguaaucaucccagcugguguaauaaugaauuguuuaaaaaacagcucauaauugaugccaaauuaaagcacuguguacccauuaagauauggcauuauugaagaaauaaaguacauuugaaaccuucauuguagguuuuguuucuuuguaaaugaaacuaagcuugaucacuuuagccuuuauguuaauauuaaagucaaaugcugugcagcuucuuaaauagguuuuuuuuuuuuuuuuuuuuuuuuuuugggacgaagucucacuuugucccccaggcuggagugcaguggcaccaucucagcucacugcgaccucugccuccugaguucaagugauucuccugucucagccucccgaguagccagaacuacaggcacaugccaugacgcccagcuaauuuuuuuuuuuuuugagacggagucucacucuguugcccaggcuggaaugcaauggcgugaucucggcuccugcaaccuccgccucccggguucaagcgauucuccugucucagccuuccaaguagcugggauuacaggugcacgccaccaggcccggcuaauuuuuguauuuuuaguagagacgggguuucaccauguuggucaggcuggucucgagcuccugaucucgugauccacccaccuuggucucccaaagugcugggauuacaggugugagccaccgugcccggcaauuuuuguauuuuuaguagagacaggguuucaccauauuggucaggcugguuucaaacucacgaccucaggugauccgccugccuuggccucccaaagugguaggauuacaggcgugagccacggcacccagcccuuaaauggcuuuuaugagguaaugugaaaggaaaauuugccuuugaccuggaagucaacuuuauaguaagcugaaauuauaaauaacugaucauggaacuauugcagaucaccuuugagccaaaaauuuggccuggauuuugguuaugccuacuacuaugugccucucauuuguauuuauaccuggaauuggcauuauuaacuccuuuucacuccugccuagaaaacuuaaagugucaccagacccaagggcggagugguccuauaaaacaaacucguagccugucugaagacuagcuacuagcuccuuggcuguuuuggcauauucaucuugauuauagcucuuggucuuucaucauauuagggauguuuaugauguuauuaaagaaaaucuugucaaaugcagucuguuccuaguuaucuacuaucagucaccuguuguauaauuauaacaauguuuggauuuguggauuauuauuuuaguauauaacauuggauuuuauguauguuaccugaagaagagcaauaucuguaccacauauuucuuuguuuuucuuuuuugagaugaagucucacucuguugcccaggcuggagugcaguggugugaucuugacacacugcaaccuuugccucccggauucaagugauucuccugucucagccucccuaguaacuggaauuacaggcgccugccaccaugccuggcuaauuuuuguauuuuuaguagagaugggguuucaccauguuggccaaccuggucuugaacuccugaccucaggcgauccacccaccucagccucccaaagugcuaggcuuacaggcaugagacaccgcgcccggcuuauauaucauuacuuucuuggcugagagcuguagucugugguaguuguuuuguuuuguuuuuuguuuuuuuuuuguaguuuucuugaucgugaucaauuaagcagaaaguagaauuucagucagguaaccugucuauauuagcuaaauuaucuuuugcuuauuacauagagugcuagaaguaugcugucauggcauauguccuaguuucucaucaaauggaccaaagucagugauuuuauuugaagaggaaaaauugaacgucauuguaaauuaaguugcaaguuuaguaaccauauuguaccacuguuugauaaauuugaacgcuuuaugguauuucauauuuagaauguucaaaauaguacugaaguauucaaauacauacaacccugagcgauauugaaguaaaauaaacauguauuuaaggaagugucaaccuucaauuaua

SEQ ID NO: 1432 - RNA, 469 nt, Homo Sapiens
caagaagacccucaccagaugcagccccucuauguuggacuucccagccuccggaaguuagaaaugugcuacaaccacucaaggucugcaaacagauuccuauuuagauguuguugagagguaaguacaacuaguucucauuaauauuucaugucuuaugugccauacuuacacugccauuuuguagucauuuguccuacagcuaaagauuaauuuauaaucagauacgugaaaucugauaugugcauuaagcuugauuauaccugacugugucuucacgauugaauuucuggaacaagagauauagauuaagacuguuguuacauguugccuacaugacuuucaaaagcuugauucccaguggcauucucaacagcagucauaaacaaugguaauucaauguauauuuauauucaacugauauauuaauuggaauauauuaaaaauacguauauuuauauucagaaua

SEQ ID NO: 1433 - RNA, 11654 nt, Homo Sapiens
ucacuucucuccccacgccuuccccugguucaccccccuuccuuccccuuucucccccucgguuaagucccucccccucgccauucaaaagggcuggcucggcacuggcuccuugcagucggcgaacugucggggcgggaggagccgugagcaguagcugcacucagcugcccgcgcggcaaagaggaaggcaagccaaacagagugcgcagaguggcagugccagcggcgacacaggcagcacaggcagcccgggcugccugaauagccucagaaacaaccucagcgacuccggcugcucugcggacugcgagcuguggcgguagagcccgcuacagcagucgcagucuccguggagcgggcggaagccuuuuuucucccuuucguuuaccucuucauucuacucuaaaggcaucguuauuaggaaaauccuguugcgaauaagaaggauuccacagaucacauaccggagagguuuugccucagcugcucucaacuuuguaaucuugugaagaagcugacaagcuuggcugauugcagagcacuaugaggacugaacgacaguggguuuuaauucagauauuucaagcuggugguccaguaccuccaaagauauggaauacacuccugaaauauccugaaaacuuuuuuuuuucagaauccuuuaauaagcaguuaugucaaucugaaaguugcuuacuuguacuuuauauuaauagcuauucuuguuuuucuuauccaaagaaaaauccucuaauccccuuuucacaugauaguuguuaccauguuuaggcauuagucacaucaaccccucuccucucccaaacuucucuucuucaaaucaaacuuuauuagucccuccuuuauaaugauuccuugccucguuuuauccagaucaauuuuuuuucacuuugaugcccagagcugaagaaauggacuacuguauaaauuauucauugccaagagaauaauugcauuuuaaacccauauuauaacaaagaauaaugauuauauuuugugauuuguaacaaauacccuuuauuuucccuuaacuauugaauuaaauauuuuaauuauuuguauucucuuuaacuaucuugguauauuaaaguauuaucuuuuauauauuuaucaaugguggacacuuuuauagguacucugugucauuuuugauacuguagguaucuuauuucauuuaucuuuauucuuaauguacgaauucauaauauuugauucagaacaaauuuaucacuaauuaacagagugucaauuaugcuaacaucucauuuacugauuuuaauuuaaaacaguuuuuguuaacaugcauguuuaggguuggcuucuuaauaauuucuucuuccucuucucucucuccucuucuuuuggucaguguugugcggguuaauacaacaaacuguaacaaguguaccugguauggacuuguuguccgggacguacauuuucgcgguccugcuagcaugcgugguguuccacucuggcgcccaggagaaaaacuacaccauccgagaagaaaugccagaaaacguccugauaggcgacuuguugaaagaccuuaacuugucgcugauuccaaacaaguccuugacaacugcuaugcaguucaagcuaguguacaagaccggagaugugccacugauucgaauugaagaggauacuggugagaucuucacuacuggcgcucgcauugaucgugagaaauuaugugcugguaucccaagggaugagcauugcuuuuaugaaguggagguugccauuuugccggaugaaauauuuagacugguuaagauacguuuucugauagaagauauaaaugauaaugcaccauuguucccagcaacaguuaucaacauaucaauuccagagaacucggcuauaaacucuaaauauacucucccagcggcuguugauccugacguaggaauaaacggaguucaaaacuacgaacuaauuaagagucaaaacauuuuuggccucgaugucauugaaacaccagaaggagacaagaugccacaacugauuguucaaaaggaguuagauagggaagagaaggauaccuacgugaugaaaguaaagguugaagaugguggcuuuccucaaagauccaguacugcuauuuugcaagugaguguuacugauacaaaugacaaccacccagucuuuaaggagacagagauugaagucaguauaccagaaaaugcuccuguaggcacuucagugacacagcuccaugccacagaugcugacauaggugaaaaugccaagauccacuucucuuucagcaaucuagucuccaacauugccaggagauuauuucaccucaaugccaccacuggacuuaucacaaucaaagaaccacuggauagggaagaaacaccaaaccacaaguuacugguuuuggcaagugaugguggauugaugccagcaagagcaauggugcugguaaauguuacagaugucaaugauaaugucccauccauugacauaagauacaucgucaauccugucaaugacacaguuguucuuucagaaaauauuccacucaacaccaaaauugcucucauaacugugacggauaaggaugcggaccauaauggcagggugacaugcuucacagaucaugaaaucccuuucagauuaaggccaguauucaguaaucaguuccuccuggagacugcagcauaucuugacuaugaguccacaaaagaauaugccauuaaauuacuggcugcagaugcuggcaaaccuccuuugaaucagucagcaaugcucuucaucaaagugaaagaugaaaaugacaaugcuccaguuuucacccagucuuucguaacuguuucuauuccugagaauaacucuccuggcauccaguugacgaaaguaagugcaauggaugcagacagugggccuaaugcuaagaucaauuaccugcuaggcccugaugcuccaccugaauucagccuggauugucguacaggcaugcugacuguagugaagaaacuagauagagaaaaagaggauaaauauuuauucacaauucuggcaaaagauaacgggguaccacccuuaaccagcaaugucacagucuuuguaagcauuauugaucagaaugacaauagcccaguuuucacucacaaugaauacaacuucuaugucccagaaaaccuuccaaggcaugguacaguaggacuaaucacuguaacugauccugauuauggagacaauucugcaguuacgcucuccauuuuagaugagaaugaugacuucaccauugauucacaaacuggugucauccgaccaaauauuucauuugauagagaaaaacaagaaucuuacacuuucuauguaaaggcugaggauggugguagaguaucacguucuucaagugccaaaguaaccauaaaugugguugaugucaaugacaacaaaccaguuuucauugucccuccuuccaacuguucuuaugaauugguucuaccguccacuaauccaggcacaguggucuuucagguaauugcuguugacaaugacacuggcaugaaugcagagguucguuacagcauuguaggaggaaacacaagagaucuguuugcaaucgaccaagaaacaggcaacauaacauugauggagaaaugugauguuacagaccuugguuuacacagaguguuggucaaagcuaaugacuuaggacagccugauucucucuucaguguuguaauugucaaucuguucgugaaugagucggugaccaaugcuacacugauuaaugaacuggugcgcaaaagcacugaagcaccagugaccccaaauacugagauagcugauguauccucaccaacuagugacuaugucaagauccugguugcagcuguugcuggcaccauaacugucguuguaguuauuuucaucacugcuguaguaagaugucgccaggcaccacaccuuaaggcugcucagaaaaacaagcagaauucugaaugggcuaccccaaacccagaaaacaggcagaugauaaugaugaagaaaaagaaaaagaagaagaagcauuccccuaagaacuugcugcuuaauuuugucacuauugaagaaacuaaggcagaugauguugacagugauggaaacagagucacacuagaccuuccuauugaucuagaagagcaaacaaugggaaaguacaauuggguaacuacaccuacuacuuucaagcccgacagcccugauuuggcccgacacuacaaaucugccucuccacagccugccuuccaaauucagccugaaacuccccugaauucgaagcaccacaucauccaagaacugccucucgauaacaccuuuguggccugugacucuaucuccaaguguuccucaagcaguucagaucccuacagcguuucugacuguggcuauccagugacgaccuucgagguaccuguguccguacacaccagaccgguagguauccaaguuucuaacacaacuuucuaacuauuuuuuuauuauuauuuucaguugauguagaacuuuacaaaaucuauugacuucaaagagggaucaaaacaaucauauucuacagauguacccaauagauauauggauucaauuaaguuugguagaagaugagaacaaaauaacuacugauuuaggaaaauuggaugcagaauaauaauuauaguaggggcaauuuugucuguagauggcaguaugacaauucuugcuagagaauauauugaaaaaaacuucaacacaaaggguuguagcacuguccucaguaccauugugugcaugaggaucagaauagucugggcuagauacaucacauuaaagcuuuucagaaucugauaaauagcucuaaauacuaaugauauugagaagccuagcuucacuugggaaaaucuguggcuguucacagaaauucagcaccaaguuauuccccccauacucuaccaggccuucagguccucauaaagaaaagugucguuuucagauuaggaacucaaaauuauuuuggugcaucaaaucuacagucacacaauauaacaagaaugggauuagaaaaaugaaagccuacucauucucaucuuuaagccagagaaugaaauauauaugaggucucuggauagcuauuuaaauauuugcauauuuaugcaagguauuuugagcccuucagaagacauucuacugauuccaggacaucaacuauugaaaucugcagugagauauaacuuucuaggaacaacaaaauuccauuccccuuccaaaaaauuucaaugauugugauuucaaaauuaggcuaagaucauuaauuuuguaaucuagauuucccauuauaaaagcaagcaaaaaucaucuuaaaaaugauguccuagugaaccuugugcuuucuuuagcuguaaucuggcaauggaaauuuaaaauuuauggaagagacagugcagcacaauaacagaguacucucaugcuguuucucuguuugcucugaaucaacagccaugauguaauauaaggcugucuugguguauacacuuaugguuaauauaucagucaugaaacaugcaauuacuugcccugucugauuguugaauaauuaaaacauuaucuccaggaguuuggaagugagcugaacuagccaaacuacucucugaaagguauccagggcaagagacauuuuuaagaccccaaacaaacaaaaaacaaaaccaaaacacucugguucaguguuuugaaaauauucacuaacauaauauugcugagaaaaucauuuuuauuacccaccacucugcuuaaaaguugagugggccgggcgcgguggcucacgccuguaaucccagcacuuugggaggccgaggcggguggaucacgaggucaggagauugagaccauccuggcuaacacggugaaaccccaucuccacuaaaaauacaaaaaauuagccuggcgugguggcgggcgccuguagucccagcuacucgggaggcugaggcaggagaauagcgugaacccgggaggcggagcuugcagugagccgagauggcgccacugcacuccagccugggugacagagcaagacucugucucaaaaagaaaaaaauguucaaugauagaaaauaauuuuacuagguuuuuauguugauuguacucaugcuguuccacuccuuuuaauuauuaaaaaguuauuuuuggcugggugugguggcucacaccuguaaucccagcacuuugggaggccgagguggguggaucaccugaggucaggaguucaagaccagucuggccaacauccaaugaaggagguugugcgaucuugcacccccaugaaagagucuacaacuauggagaucuggauucauccccaaccacagcggaaaucugaagggaaaguggcaggaaagacugugcuuacuuccucuuccccuucugccaugaccucccagcggcgugucacauuucaccugccagaaggcucucaggaaagcagcagugaugguggacugggagaccaugaugcaggcagccuuaccagcacaucucauggccugccccuuggcuauccucaggaggaguacuuugaucgugcuacacccagcaaucgcacugaaggggauggcaacuccgauccugaaucuaccuucaucccaagcuuucauaccuggacuaaagaaaggagcccaacagcugcagaaauaacuguucaaccaacuguggaagaggccucugacaacugcacucaagaaugucucaucuauggccauucugaugccugcuggaugccggcaucucuggaucauuccagcucuucgcaagcacaggccucugcucuaugccacagcccaccacugucacaggccucuacucagcaccacagcccacgagugacacagaccauugcucucugccacagcccuccagugacacagaccaucgcauugugccacagcccaccaccgauacaggugucugcucuccaccacaguccuccucuagugcaggcuacugcacuucaccacagcccaccaucagcacaggccucagcccucugcuacagcccuccuuuagcacaggcugcugcaaucagccacagcucuccucugccacagguuauugcccuccaucguagucaggcccaaucaucagucaguuugcagcaagguugggugcaaggugcugaugggcuaugcucuguugaucagggagugcaagguagugcaacaucucaguuuuacaccaugucugaaagacuucaucccagugaugauucaauuaaagucauuccuuugacaaccuucacuccacgccaacaggccagaccguccagaggugauucccccauuauggaagaacaucccuuguaaagcuaaaauaguuacuucaaauuuucagaaaagauguauauagucaaaauuuaagauacaauuccaaugaguauucugauuaucagauuuguaaauaacuauguaaauagaaacagauaccagaauaaaucuacagcuagacccuuagucaauaguuaaccaaaaaauugcaauuuguuuaauucagaauguguauuuaaaaagaaaaggaauuuaacaauuugcauccccuuguacaguaaggcuuaucaugacagagcgcacuauuucugauguacaguauuuuuuguuguuuuuaucaucaugugcaauauuacugauuuguuuccaugcugauuguguggaaccaguauguagcaaauggaaagccuagaaauaucuuauuuucuaaguuuaccuuuaguuuaccuaaacuuuuguucagauaacguuaaaagguauacguacucuagccuuuuuuugggcuuucuuuuugauuuuuguuuguuguuuucaguuuuuuuguuguuguuagugagucucccuucaaaauacgcaguagguaguguaaauacugcuuguuugugucucucugcugucauguuuucuaccuuauuccaauacuauauuguugauaaaauuuguauauacauuuucaauaaagaauauguauaaacuguacagaucuagaucuacaaccuauuucucuacucuuuaguagaguucgagacacagaagugcaauaacugcccuaauuaagcaacuauuuguuaaaaagggccucuuuuuacuuuaauaguuuaguguaaaguacaucagaaauaaagcuguaucugccauuuuaagccuguaguccauuauuacuugggucuuuacuucugggaauuuguauguaacagccuagaaaauuaaaaggagguggaugcauccaaagcacgagucacuuaaaauaucgacgguaaacuacuauuuuguagagaaacucaggaagauuuaaauguugauuugacagcucaauaggcuguuaccaaaggguguucaguaaaaauaacaaauacauguaacuguagauaaaaccauauacuaaaucuauaagacuaagggauuuuuguuauucuagcucaacuuacugaagaaaaccacuaauaacaacaagaauaucaggaaggaacuuuucaagaaauguaauuauaaaucuacaucaaacagaauuuuaaggaaaaaugcagagggagaaauaaggcacaugacugcuucuugcagucaacaagaaauaccaauaacacacacagaacaaaaaccaucaaaaucucauauaugaaauaaaauauauucuucuaagcaaagaaacaguacuauucauagaaaacauuaguuuucuucuguugucuguuauuuccuucuuguauccucuuaacuggccauuaucuuguaugugcacauuuuauaaauguacagaaacaucaccaacuuaauuuucuuccauagcaaaacugagaaaauaccuuguuucaguauaacacuaaaccaagagacaauugauguuuaaugggggcgguuggggugggggggggagucaauaucuccuauugauuaacuuagacauagauuuuguaauguauaacuugauauuuaauuuaugauuaaacuguguguaaauuuuguaacauaaacugugguaauugcauaauuucauuggugaggauuuccacugaauauugagaaaguuucuuuucaugugcccagcagguuaaguagcguuuucagaauauacauuauucccauccauuguaaaguuccuuaagucauauuugacugggcgugcagaauaacuucuuaacuuuuaacuaucagaguuugauuaauaaaauuaauuaauguuuuuucuccuucguguuguuaauguuccaagggauuuggagcauacugguuuuccaggugcaugugaaucccgaaggacugaugauauuugaauguuuauuaaauuauuaucauacaaauguguugauauuguggcuauuguugauguugaaaauuuuaaacuuggggaagauuaagaaaagaaccaauagugacaaaaaucagugcuuccaguagauuuuagaacauucuuugccucaaaaaaccugcaaagaugaugugagauuuuuucuuguguuuuaauuauuuucacauuuucucucugcaaaacuuuaguuuucugaugaucuacacacacacacacacacacacgugcacacacacacacauuuaaaugauauaaaaagaagagguugaaagauuauuaaauaacuuaucaggcaucucaaugguuacuaucuauguuagugaaaaucaaauaggacucaaaguuggauauuugggauuuuucuucugacaguauaauuuauugaguuacuagggagguucuuaaauccucauaucuggaaacuugugacguuuugacaccuuuccuauagaugauauaggaaugaaccaauacgcuuuuauuacccuuucuaacucugauuuuauaaucagacuuagauuguguuuagaauauuaaaugacugggcacccucuucuugguuuuuaccagagaggcuuugaauggaagcaggcugagaguagccaaagaggcaagggguauuagcccaguuauucuccccuaugccuuccuucucuuucuaagcguccacuaggucuggccuuggaaaccuguuacuucuagggcuucagaucugaugauaucuuuuucaucacauuacaaguuauuucucugacugaauagacagugguauagguugacacagcacacaaguggcuauugugauguaugauguauguaguccuacaacugcaaaacgucuuacugaaccaacaaucaaaaaaugguucuguuuuaaaaaggauuuuguuugauuugaaauuaaaacuucaagcugaaugacuuauaugagaauaauacguucaaucaaaguaguuauucuauuuuguguccauauuccauuagauugugauuauuaauuuucuagcuaugguauuacuauaucacacuugugaguauguauucaaauacuaaguaucuuauaugcuacgugcauacacauucuuuucuuaaacuuuaccuguguuuuaacuaauauugugucaguguauuaaaaauuagcuuuuacauaugauaucuacaauguaauaaauuuagagaguaauuuuguguauucuuauuuacuuaacauuuuacuuuuaauuauguaaauuugguuagaaaauaauaauaaaugguuagugcuauuguguaaugguagcaguuacaaagagccucugccuucccaaacuaauauuuaucacacauggucauuaaaugggaaaaaaauagacuaaacaaaucacaaauuguucaguucuuaaaauguaauuaugucacacacacaaaaaauccuuuucaauccugagaaaauuaaaggcguuuuacucacauggcuauuucaacauuaguuuuuuuuguuuguuucuuuuucaugguauuacugaagguguguauacucccuaauacacauuuaugaaaaucuacuuguuuaggcuuuuauuuauacucuucugauuuauauuuuuuauuauaauuauuauuucuuaucuuucuucuuuuauauuuuuuggaaaccaaauuuauaguuaguuuagguaaacuuuuuauuaugaccauuagaaacuauuuugaaugcuuccaacuggcucaauuggccgggaaaacaugggagcaagagaagcugaaauauauuucugcaagaaccuuucuauauuaugugccaauuaccacaccagaucaauuuuaugcagaggccuuaaaauauucuuucacaguagcuuucuuacacuaaccgucaugugcuuuuaguaaauaugauuuuuaaaagcaguucaaguugacaacagcagaaacaguaacaaaaaaaucugcucagaaaaauguaugugcacaaauaaaaaaaauuaauggcaauuguuuagugauuguaagugauacuuuuuaaagaguaaacugugugaaauuuauacuaucccugcuuaaaauauuaagauuuuuaugaaauauguauuuauguuuguauugugggaagauuccuccucugugauaucauacagcaucugaaagugaacaguaucccaaagcaguuccaaccaugcuuuggaaguaagaagguugacuauuguauggccaaggauggcaguauguaauccagaagcaaacuuguauuaauuguucuauuucagguucuguauugcauguuuucuuauuaauauauauuaauaaaaguuaugagaaauaaa

SEQ ID NO: 1434 - RNA, 101 nt, Homo Sapiens
ucaguggaaagcaugcauccaggguguggagccaaaauuagaagggccaaaauucuaccuggcccacuaccacagcaaccuugggcaucguuuucuuuuga

SEQ ID NO: 1435 - RNA, 4088 nt, Homo Sapiens
acggaaacagaaauugcuuugcggcccgcacggaaauugcuuuccuucggcuuccguucuugguccaugugagagaagcuggcugcugaaaugacugcgaaccggcuugcagagagccuucuggcuuugagccaacaggaagaacuagcggauuugccaaaagacuaccucuugagugagagugaagaugagggggacaaugauggagagagaaagcaucaaaagcuucuggaagcaaucaguucccuugauggaaagaauaggcggaaauuggcugagaggucugaggcuagucugaaggugucagaguucaaugucaguucugaaggaucaggagaaaagcugguccuugcagaucugcuugagccuguuaaaacuucaucuucuuuggccacugugaaaaagcaacugaguagagucaaaucaaagaagacaguggaguuaccucugaacaaagaagagauugaacggauccacagagaaguagcauucaauaaaaccgcacaaguccucuccaaaugggacccugucguccugaagaaccggcaggcagagcagcugguuuuuccccuggagaaagaggagccagccauugcucccauugaacaugugcucaguggcuggaaguuuaaaguguggcugcaggaugaagggagacuuuagaaaaaaaaaaucagaggcaagaacuccccuggagcaggaaauuuucaaccuccuccauaagaacaagcagccagugacagacccuuuacugaccccuguggaaaaggccucucuccgagccaugagccuagaagaggcaaagaugcgacgagcagagcuucagagggcucgggcucugcaguccuacuaugaggccaaggcucgaagagagaagaaaaucaaaaguaaaaaguaucacaaagucgugaagaaaggaaaggccaagaaagcccuaaaagaguuugagcagcugcggaagguuaauccagcugcagcacuagaagaacuggaaaaaauugaaaaggccagaaugauggaaagaaugagccuuaagcaccaaaacagugggaaaugggccaagucaaaggcaauuauggccaaauaugaccuggaggcucgccaagcuaugcaggaacaguugucuaagaacaaagaacugacacagaaacuccagguagccucugagagugaggaagaggagggaggcacagaagauguggaagaacuccuugucccugauguagugaaugaagugcagaugaaugcagaugggccgaaucccuggaugcucaggagcugcaccagugacaccaaagaggcugcaacccaggaggacccugagcaacugccagagcuugaggcccauggaguuucugaaagugagggagaagaaagaccaguggcagaagaagaaauuuuguugagagaauuugaggaaaggcgaucccuuagaaaaagaucugagcucagccaagaugcugagccagcaggcagucaagaaacaaaaggugagcugugaucaaauggaagagggaaauuccuagugcuguggacagacuaugggagaaaaaaaaaauguguccacccacacacaaaacugcauagugauuaggcgcuggggacuugcaagagugcguacacuggaucccugaagagaaauuagauucauaacuauuuuucuucgaagacauuuaauaagcagucaucugcauggccgugcaacgugguucaggcacauuuucuguucuugggggcuuacagccuucagaaacccauaauaacuaaaccauacucgaagucaggguaugaguuagcguuccugguaccuacacaccagggagaaguacguaugguagaauggcaaaucugaaaguccauucacaccuguagacacagauaggucaauuuugagacauuaggaaacauugucuaguugcuggauuuuuuuguuuuguugguuaaguaggaguggcauuuuuagcacuucuuaaugcuaguugauguguguauacauggggugagacuuuacggaaugaaugacuccacagggccacauggcaaauuagaauugugacuccauacucaggcucuauuuguauguuauauuuucuaccuguuaucuugaagagaucuuauugacaauguuagcaccugugagauuggucagagaguucccauucuggcaauaaaccaggacacuaaaaaaccugccuaggaaacuagcuacauugagaaaucacuuggcuaucuggacaaauuaccaggucugguuugguuucacauaggaaugcauuuagaugauggcaaaaaucugguuuuacacggcaaaagaauuauuuuuuucuacuuuuuuuuguuuaagagacaggguuuugcucugucauccaggcuggaauacagcagugcaaucauaccuuacugcagccuaagaccucccaggcucaagcgauccucuuggcucagccucccaacuagcugggacuacaugcacgugccaccaugcugagcuaaguuuuuguagagacugaggucuugcucuguugcccaggcuggucuugaauuccuggccucaagcuauccucucaccucagccucccaaaguguuaggauuacaagugugagccaccgcacccagccuccuuuuuuuuuuccuuuuuuuuuuucagguuuccacauacaaaaauuuauuuuaaaagagcuaucauuuagaauauauuauagggaccuuuacuuaauaguuuuggcuggauauuuuugggauuaauaauugcaaguagucacuucugagagaauuuuggaaagcagcacagcgggcugagauuguggggguguacauauaugaccacaggacccuaguggcuuucucuugagcccccucaacaacuggccaucuagcuaaaugugcagagcggcugacugugauaugaaagaaugaaagauagauuugcauuuccuuggacaguaaauaaauugaauuuucucacauucuggcagccaggaggugcugucugaauugagaguacuaucucagaaauugaaggaaaaccaucaguccaggaagcaaaaagcaaguucagaggggacuauuccccagguccagagagaggaaccugccccagaagaagaggagccccuguugcuacagagaccagagagaguacagacgcuggaagagcuagaagagcugggaaaagaagaauguuuucaaaauaaggagcuucccagaccuguguuagaagggcagcagucagagaggaccccaaauaaucgcccugaugccccuaaggagaagaaaaagaaggagcaaaugaucgaccuacagaaccuccuaaccacacaaucucccuccgugaagucuuuggcaguucccacaauagaggagcuggaagaugaagaggagagaaaccauaggcagaugauaaaggaagcuuuugcuggggaugaugucaucagagauuucuugaaagagaagagggaagcuguggaggcgaguaagccaaaggacguggaccugacacuaccuggcuggggcgagugggguggugugggccuaaagcccagugccaagaaaagacgccgguuucucauuaaagccccugaggguccuccaagaaaagauaagaauuugccaaaugugauuaucaaugagaagcgcaacauccacgcagcugcucaucagguacgagugcuuccauauccauuuacccaccauuggcaauuugaaaggaccauccagacccccauaggauccacauggaacacccagagggcuuuccaaaagcugacuacucccaaggucgucaccaagccaggccauaucauuaaccccauaaaagcagaagacgugggcuaccggucuuccucaaggucggaccugucugucauacagaggaauccaaaacgaaucaccacacgucacaaaaaacagcugaagaaaugcucuguagauugaguugcuggaggagugacagccaggagcccugacuucacuuccuuugguccaguuuuacucugauacaggguggauuccaaaacuggcucaguacauugcauguaguuaagccacauuuuaaaaauaaaggcauuuuuuaaucuauuuaccugga

SEQ ID NO: 1436 - RNA, 2938 nt, Homo Sapiens
aguuucccuccgcagcggcggcggcggcugccccucggcuccaggagaggccgccacccgggguuccgguggcguuaggcugcagcaguggcgcuucccgccgcccgagcuucggaaacuucccggccgcgacgcagggaaccggcgcggagaaccgagcagagcggagcuagcuuggccucuucccuaagaaauaaagaaggcacuuugggguccaagguaggguacuuagauguggaagcaaggggccccggggaggggcggggaggcggcggagagagcaguuuccaagguggaagcuggguccggcugccaggaagcggccggugcgcgggcugcgcgggcugcgcggggcucggcuuccacgugcgagccugcaccgccgccccgcccucuccuggcggccaggccuggggacucucugccgcgggacggcgccucgcguuccgccguggcaguggccguggccagaacguccacgcgcggucguccaccgccggaucucgcuccagggguagggggagaugggggaccgggggccagaccaccucugagaggacucgcugaggcccagcaccucggcgccuccucuguuccccuggcccaccuggcccugggggagaucuaggccucgaacggcacuccucgcacgcacacccccagccagagucggaagcucgaacuuggggagcguucgcgagaagaccgagacaggagcagaaaggggcgcccgugguccagcguguagggagccgaucgcccauggagggucugggccgcucgugccuguggcugcgucgggagcugucgcccccgcggccgcggcuccugcuccuggacugccgcagccgcgagcuguacgagucggcgcgcaucgguggggcgcugagcguggcccugccggcgcuccugcugcgccgccugcggaggggcagccugucggugcgcgcgcuccugccugggccgccgcugcagccgcccccgccugcccccgugcuccuguacgaccagggcgggggccggcgccggcgcggggaggccgaggccgaggccgaggagugggaggccgagucggugcugggcacccugcugcagaagcugcgagaggaaggcuaccuggccuacuaccuccagggaggcuucagcagauuccaggccgagugcccucaccugugugagaccagccuugcuggccgugccggcuccagcauggcgccggugcccgguccagugcccguggugggguugggcagccugugccugggcuccgacugcucugaugcggaauccgaggcugaccgcgacuccaugagcuguggccuggauucggagggugccacacccccaccaguggggcugcgggcauccuucccuguccagauccugcccaaccucuaucugggcagugcccgggauuccgccaauuuggagagccuggccaaacugggcauccgcuacauccucaaugucacccccaaccucccaaacuucuucgagaagaauggugacuuucacuacaagcagauccccaucuccgaccacuggagccagaaccugucgcgguucuuuccggaggccauugaguucauugaugaggccuugucccagaacugcggggugcucguccacugcuuggcgggggucagccguucugucaccgucacuguggccuaccucaugcagaagcuccaccucucucucaacgaugccuaugaccuggucaagaggaagaagucuaacaucucccccaacuucaacuucauggggcaguugcuggacuuugagcgcagcuugcggcuggaggagcgccacucgcaggagcagggcaguggggggcaggcaucugcggccuccaacccgcccuccuucuucaccacccccaccagugauggcgccuucgagcuggcccccaccuagggccccguggccggcaggccggccccugccccacccccacccacgggugucccugcccacucguguggcaagggaggggagggcaggagggcucggccugagcagggugcuggggggagagcgcaauaccucacgcgggcugccguccuaaucaacgugccuauggcgggaccacgcucggagccugccucuucugcgacuguuacuuuuucuuugcgggauggggguggggguucccucuccaggugguuguccaggcccaugucccggcccugggugcucagccagcucggcuaggcccugcgccucccugcgcuucccccuucaggaagggugugugccaccucguugcacuggaucccaguggcugcuugggggagaggcguuugccaucacugguguugucaccucccuguuucuccaccaagggcuugggccucucggggcuggggccucccaggggauggggacccagagugcaguggccgcccacauccauggccuaggagcuacugggcagguucccggccacacaucuggugggcuguuuuguuuuuuuuuuuuccucuucccccagaugucuugacgggaucacuggggcucuuugugagugaggguggccaaacuaccgccggaggagauggggucucagagcgagagcugcggagggggaggggaagaagaaggccucacuuuugcugcugcggggcccacacagccgcugcuacuuugggggguggggaaggggccaagcugcagacacacacagucauucauuucuguccacaccccuguggguggcgggugugcgugugugugcuugugugugcgcacgugucggcgcucacacacacaugcuagcccacugaugcacccagcccagggcuggcagucuuugcagcguggggccgucucacccuggagccuggagaggaucuaugcuuguuuguuuuuguaauccauaucauaguugcuuucuuuaauuguuccuucugaauaaacaguuuauuuaagauacuga

SEQ ID NO: 1437 - RNA, 1702 nt, Homo Sapiens
cuuggggcggcgagcauggcggcagcggcugcaggccugggcggcggcggcgccggcccgggacccgaggccggggacuuccuggcccgcuaccggcugguaucgaacaagcugaagaagcgguuccugcggaagccgaacguggcggaggccggcgagcaguucggacagcugggccgggagcugcgcgcccaggagugucugcccuacgcggccuggugccagcuggcgguggcgcgcugccagcaggcgcucuuccacgggcccggggaggcgcuggcccucaccgaggccgcccgccucuuccugcggcaggagcgcgacgcgcgccagcgccuggucugccccgccgccuacggggagccgcugcaggccgccgccagcgcccugggcgccgcggugcgucugcaccucgagcugggccagccggccgccgccgccgcccucugccucgagcuggccgccgcccugcgcgaccugggccagccggccgccgccgccggucacuuccagcgcgccgcccagcuccagcugccccagcugccccuggccgcgcugcaggcgcuuggcgaggccgccuccugccagcugcuggcgcgcgacuacaccggcgcccuggcggucuucacgcgcaugcagcgccuggcgcgggagcacggcagccacccggugcagucacugccgccgcccccgccgccggcaccccagcccgggcccggggcgacgcccgcccuaccggccgcgcugcuuccuccgaacuccggcucggcggcgcccucucccgccgcccugggcgccuucucggacgugcugguccgcugcgaggugucccgcgugcugcugcugcuccuccugcaaccaccgcccgccaagcugcugccggagcacgcccagacccuggagaaguacuccugggaggcuuuugacagccacgggcaggagagcagcggccagcuucccgaggagcucuuucugcugcuccagucuuuggucauggcuacccacgaaaaggacacggaagccaucaagucgcugcagguggagauguggccacuguugacugcugagcagaaccaccuccuucaccucguucugcaagaaaccaucucccccucaggacagggagucugauccaucccauucacccagugacuucuuuuugcccaggccuggacuuuuugcaucagucacguuaaccagaugacuuugccuguuaccaaaccucaugcauccacguuugcgucuggggaggaauaaaaagacaucguucccgcuucugcguuuuguuauuccuacugccgccauaggaauuauuucguuggcugaacguuaccagcaccccgagaacacauuuugauagaaucagaguagaggacauggcugucuucuaaaaagccacgacaugaaaaugacaaucccuuucgucuccuuccuccgcugcuuccaccuaacgcagccuccugccuccgccuuuguuucauagugaggauuuuauuuugcacggcgcccucccucuaaauaccuacccuagaugauuucauccugccccucacuucuuaacauauuccugugucuuuguaauggccaaauuucuccuuccacucguccgcacgguacgucuucaugggagucauuuuauuccuuacagcuuccuuguaaccacagcccuaaauccaugauaaagcuacucuuguacuccuca

SEQ ID NO: 1438 - RNA, 1340 nt, Homo Sapiens
gucuguaacaauuuuaaaauaaaagccagcauauuggugggaaaaaaaacaaaaauccaacaacaacaaaaauaaaacacaacaaggcauauacuuccaauauuuccacuguauaaacccaauccauggauuaugcaaaagagauaagucucuuggaaaugacagucauuuggugacaauaacaaaucagcaacagaggagacuuuaacgaguuacucacuguuuccucccucaccaaaggcaucugcuaagucaaagucugccccuaaaggaaggaaucggucuguucauaguaaagcucugagaaaugaggaaggaaugaccucggaaacagauggagaaaucaccagagacccacaugacuaaagacuuuucugaauaucacacugacuaggaucucauuugaaaaaguaaauuccugaucauuuucacaucauucuucccccagaugaaaagaguaagagaugacagcaagagaaagagggagagagaaagaaugucauuuguaaaucaacugugcugccuggacccaguugggacucugaaucugccugcacacaacucugucccguugauuccccauuaucuccucccagguccccaacaccuucagcaaggcagaccguaagagaaauaaacagaaaaauaguggacaugaaaauggauucagaguaacaaaaacaaggaaaaaacacuuuagaaacccauugacagaaucaacaagaggaagagacaaaucgaaucucaaagaaaaagcucaggccggcaugguggcucacaccuguaaucccagcacuuugagaggcugagaugggcggaucaccugaggucagggguucaagaucagccuggcuaacauggcaaaaccccgucucuacugaaaauacaagaauuugccgggcaugguggugcauguuuguaauccuagcuaauugggaggcugaggcacgagaauugcuugaacccaggaaguggagguugcacugagccaagaucacgccacugcacuccagcccgggcgacagagagagacucugucuccaaaauaaaaaaaggaaagaaaauaaaagaaaaaacucaacauugaaaacguguuaccauuccuucaaucaaccuauggugauaaacaauucaaaugaaauuaaaaagaagguuuuacuucucugaagagaagggacaauagcaaaaugauucucaauuuaaaaggaaaaaaaguuacaaaaagcaggauauccacacaaacauaagacaccauaaaaaaauaaacauaccacuuguaaaacauuccuguuaaaaauauucaaaggcaaaaauaaagugcaaaaccauuuucauaauaa

SEQ ID NO: 1439 - RNA, 4808 nt, Homo Sapiens
ccgagcugcaggaggccgcgggcgcgagacugggaaugcgcagggcccccgccuggcucuacaagcccgggccgcggcccccgccuuccccgccgccucccggcgcuccgugcccgccccacgaggccggcggcugcugcuaccuggggccguugcugcuugugccgugagcgacggccagccauuguccccgccgcuccgucagccgcgcccggccgcgcgcgcaccggaaggcgcauuggcgucuugcgggcuccgggccgggugggcaggauggccuccacaagccgcauggcgcgcauggggagccuccguugaugccgccgcgccgcccuccgaggcugcauccgcggaagcccggcuccccgagcgcuccggcccggcccggcgccccggaccugagugcguccccaugaaggcgcccgggcuggcccaggcggccguggcagaggagaccccggacugggcgcccgagcucugccccagcuccgaggcgcggucgccggagccgccugccaaccgccuucaagacuucgacacgcuggucaccgugggaaagcaacuagaagccauuugugucaagguaacgucuggagaaacaaaaggucaggaauggccaacgucccuacuggccacaguccagccccaaucugcaagacagagccagccgccccgggggaauucccgccuggugggacuccacgucaccagcccccagcugcucaggguacagccccucgugagaaccgagccacagucauguuuccuacaucagccuccugcucagggguuuguacagagaccacugccagcccucuagguggucccugcaaagagagucccagcccccaaggcuccaaauggacagggcaccauguugaccccuucgucggccuccaguuugccgacuguaacauguuucauccaguucaggacguuuauuuauuuccaacuugcauacaaaacauacugagaaacuaaaaccaucguuaaaagugaagacacguugagacagguaucucgaccugccaaguauaaagcuaaagcugaguucauaaaaagggaugauuuggccgacggucaucugccagauucugaugaugauucagaagucaguguggaagaagaucagagggagaggcaggcgcucuuugacuuaucaagcugcucccugaggcccaaaagcuucaagugucagacuuguaaaaagucauauauagggaaguggggacuggcccagcauuuuaaacuuaauccaggccauggccagcuggacccugagauggugcuaucugagaaagccaaugggagcacccuccgggggugcacagaggaaaggacgcucagccugaccuucccggggcuguccgugccagcggcuccgcgugagggaggggcccgcuccugcuuggugagagagucagcacgcgguggccugcagucucacucuguggcccaggcuggaguacaguggcgcagucugaguucacuacagccuccaccucccagguucaagagauucuccugccucaaccucccgaguagcugggacuacagucacguaccaccaguaauuuuuuauauuuuuagcagaaacgggguuucaccacguuggccaggcuggucuugaacucuugaccucaagugauccauucaccuuggccucccaaagugcuggaauuacaggugugagccaccgcaccuggccuguguauuuaccuuguaugcuacuacauugcugauuucauuuauuaguuuuuuuuuuuuuaauucuuuuuuaaaaaagaaaaaacagacacagucucgcucucuugcucugucgcccaggcuggagugcaguggcacaaucuuggcucacugcaaccucugccuccaggguucaagugauucucgugccucagccucccaaguagcugggaccacaggugcccaccaccaugccuggcuaauuuuuguauuuuuuuguagagaugggguuuugccagguuuugccauguuggugaggcuggucucgaacuccugaccucaagugaucugcacacgucugacucccaaagugcugggauuauaggcacaagccaccaugccuggccucauuuauuaguucuaacgugugugugugcacacacgcucuuuaggcauuucuacuuauaagauccuaucugcaaauagagauaauuuuacuucuuuucccagcuacauauaaggaauuugaaagucacauaaaaugguuaagaaaaugugccaagauuaccucaguaauucuggucuguguucucaggagacccuggaaauaaacaaugcaaggcagguggaucacaaggucaggagaucaagaccauccuccuggcuaacaaggugaaacccugucucuacuaaaaaaaauacaaaaaauuagccgggcgugguggcauguaccuguagucccagcuacucaggaggcugaggcaggaaaaucgcuugaacccaggaaguggagguugcagugagccaagaucauaccacugcacuccagccugggcgacagagggagacuccgucucaaaaagaaaaaaagcaauaaaugcucuuccagaaaacucaaaaaugaagauaagcuaaaagaaaauggaaagcaccagaauaccagaaucuuuccacucacugaugaucagaguuaauaccucagugucuucuguggcuucagcgucaccuagugcaggcugccauucaacaaacgcauugucaacagucaaccaaaagaaacccauuggccaccauacccugaggacuaacccugacacagaugcccuuccagaugcccucaauagucuaacugauuccaucgccccagccuugggggagaagcacugcugccuaugcacuccauuuacaggcuaaaaucacacucgauguuuuuaugggaucauuugaucuggacauugucaaagaaaaaauugcaccagacaaguuaaaccuucaaggaaggacucagucaggacuacugcaauacggaagagaggagcuuaacuucauugaaacaaaaggcuggggaguuuuuaagugccggggugagaugcugagaaggaacuggagacaucaggaagagguuaggaaaugccguaaagcuaucugcguuggcucauuggaauuuuucaaaacugggaaucugcccuucuacaaaaacugagacacagauguaucaucuccuucaauaauugcauuuuaaagggauggcucugaagucuugagaaaggcauuccuggguugcaaaacuaggaggaggcuagaagaaaauuugggagaagauuugccucucaaagagguagagaaagaacucacaauugcaaguuuccuaaaauaaauccuccgugaaaaaaggaggccugauggauggaacuggaggucauuauguuaagugaaauaagccaggcacagaagaaaaauacugcauguucucacucacaugugggagcuuaaaaccuggaucucaugaagauagguuauagaguggaaagucccacaaucuuuuucuucucuauuuucagaaaaacguugaccucuuggcgagaaugcaaagaagggaacgcuugcuuauacgcuguuggugaacugucaccccuacaacucagcuugcaaccagcccuggccaccaguuuccccacacugagcugaauaucggacaugcccaucucagacauuccagcccauucugaaauuccacaucgauucaccugacaaagucugaaguuccagggcaauuuaucuggaaaagcuuaccuggaaucacgugucauuucaaccaacaacuguugaagaggacguggcauuaaaaccaaggguaucaauuauuuauaagggcugugugcugguugguccaagcaucucuccuucacgccaucacuccuuucaagagcugccucuguuuucuaauuuagcacaggaauuuagaugccccuaaauaaguaggcauccaguaucugcccacaccaguuuuagugagaguacauauggagacacuaccaccaccccugcucuccuacugcauaccccaccaugccaaagcaugguggcucacaccuguaaucccagugcuuugggaggccaaagaggaggaacacuugagaucagaggucugagacgagccugggcaacauagugaaaccucauuucuacaaauaaguuaaaauauauauauguagggcauaguggcacacaccugugguuucagcuuuucagcaagcugaggccggaagaucacuugagcccaggaguuugaggaugcagugagcuaggauuaugccacugcacuguagccugggcagcggagagaccccaucucuaaaaagaggagaaggagggaaaauacuucuccuucucagacccaaaguaaaaagguuucuggucucacacugaccagaaaaacauugauauuuacuuaagcaauauuaaaagggucacugcuuuagaacaggauuaaagagaaaguaaaaucaacauugagauaggaggacagaggccaucaacugaguucugaucccaaugaagacgagaaaaggcuacaacuaucuagguuaaauaucuacuuguccuagaaaaagccuuuuggcagcaacauaaaauucauaccucuuaguuuuuaaauuccuauggaugcugaagcaaauaaccacaauuuggguggcugaaaguaacagaaguuuauucuuuccaguauuggaaaccaggaaucugagaucaaguugugggcagggcuggacucccccuggaggcucuaggggguguuccuuccugccucuuccaguucuugguggcuccaggugacgcug

SEQ ID NO: 1440 - RNA, 348 nt, Homo Sapiens
uucucugagaucugcuuuuacugaaguggaucaaugaugaaacuagccaaaucugagcaucagaaggcuuuccggucuaccugaugcaugaucucuacaguucugagaagcagaacuauaaaacaauguaaaacaauaagggcauaugucugguguguguguggggggugugugugugugugcacgcacacguguuuauaaagguagcaguuguaggaaugaaugagauugggggugagggggugcauauguaugucuaugaaagccuaaucauuucugggcaaugauguaaagguuuuacgacugaccuuuguaacuaugaaguuuucuacacuugaccugagcuca

SEQ ID NO: 1441 - RNA, 7406 nt, Homo Sapiens
guacuuuagccuuccaggcuuagggacucaggcugcccagaccugaagcggugugcggccauggaccgcggagcugccgcagcccagggcacugccccgccucaggauggagagcagcccgcugagucuccagagccuccgccgccuuggccgccgccgccaccaccaccggcuccgccgccggcuccgccgcugcucuccgaggcuucgccagaacccauaccagagcccuguccagagcuugcuccaggucccuguccagaggcgaccucagaaucagccacagaacuguacacagaaccgaccccagaaccagccacagagccggccucagaaccggccccagaaccugccacagagccggccccagaaccugccacagagccggccccagaaccggccccagaaccugccacagagucugccccagagccgacuccagaaccugcccuagagucggucccagagccggccccagagcugacuccagaaguugccccagagcuggccccagagccgaccccagaaccugugacagagcuggccccagaguucugcccugaggcggcuccagaguuccguccaaguccagcaccaugucuauugcaauguccgguggacacucgagagagaggucuaaagaccucgccaucgccaucgccaucgccaucgcccagaacgccaaugucgugguccagaauaaagaaaauauugaaggaaggaccuaugcugaagaacuguaacucuuucaagagauggaagcuuagauauuuucugguucaaggacagaagcucuacuuugcacaccaucccgcguuugcacacuuugaaacgauugaucugucucaagccacuguggcagaaagcagcuguagaaaccuuugccacaguuuuuguguuauuacaccacaacgaaaaaucacucuggcugcacccaaccggaaagacauggaagaauggauuaacaucauaaaaaccauccaacagggagaaauuuauaagauaccugcagcagaaaacaacccuuuucuuguuggaaugcauuguugguacuccaguuacagccaccggacccagcacugcaauguuugucgagagagcauuccugccuuaucuagagaugccaucaucugugaagugugcaaagugaaaucucacagauugugugcuuugagagcaagcaaagacugcaaguggaauacauugucuaucacugaugaccuccuucugccugcagaugaaguaaacaugccccaucaauggguagaaggaaacaugccugucagcucucagugugcagugugucaugagagcuguggcaguuaucaaagacuucaagacuuccgcugccugugguguaauucuacggugcaugaugacuguaggagacgguuuuccaaggaauguugcuucagaagccaucgcucaucagucauuccucccacugcucuaagcgaccccaaaggcgauggccaauuaguaguaucuucagacuucuggaaucuugauuggucaucagccuguucaugucccuugcucaucuucaucaacuccaaaaguggcgaucaucaggggaucgucuuccuccgaaaauucaagcaauaccuuaacccaucucaaguguucgacuuauugaaggguggaccugaagcagggcugucuauguucaagaacuuugcucgcuuucgcauucugguuugugguggagauggcagcgugagcugggucuuaucucugauugaugccuuuggauuacaugaaaagugucaguuggcagucaucccacuuggaaccggcaaugaucuggcucguguucugggcuggggugcauucuggaacaaaagcaagucaccucuggacauccucaacagaguggagcaggcuagugugaggauccuagacagauggagugugaugauucgugagacucccagacaaaccccgcugcuaaaaggacagguugaaauggauguaccacgauuugaggcugcugccauccaacacuuagaaucugcagccaccgaguugaacaaaauccugaaggccaaguaccccacagagaugaucaucgcaaccagauucuuguguucagcuguggaagauuuugugguugauauuguaaaggccuggggucagauaaaacagaacaacacugcaauagugucugugauuuugaaaagugacuuaauguaugauaggcucaguguccugaucgauguccuggcugaggaggcagcagcuacuucugcugaaaaaagugcuacagaauaugcagacagcagcaaggcagauaggaagcccuucauuccucaaauagaccacauagccaagugcaaguuggagcuggcuacaaaggcccagagucuccagaaauccuugaaacucaucauauuucaaguugaacaagcucuggaugaggaaagcagacagacaauaucuguuaagaacuuuaguucaacuuucuuccuggaagaugacccagaagauauuaaccagacaagcccacgacgccguucucgucguggcacuuugucuucuauaucuucucucaaaagugaggaccuggacaaccuuaacuuggaucacuuacauuuuacaccugaaucuauacgcuucaaagaaaaaugugucaugaacaacuacuucggaauuggacuggaugcuaaaauuucucuggacuucaacaccagaagagaugaacacccagggcaauacaauagccgccuuaagaacaagaugugguauggccuucugggaaccaaagaacuuuugcagcgcucuuacaggaaacuggaagaacgagugcauuuggagugugauggagaaaccaucuccuugccaaaccugcaaggcauuguagugcucaacauuaccagcuaugcuggagguaucaacuucuggggaagcaacacagcaaccacggaauaugaggcuccugcaaucgaugaugggaaacuggaggugguggcaaucuuugguucugugcagauggcaaugucccguaucaucaaccugcaucaucaucgcauugcccagugccaugaggugaugauaaccauugauggugaagaagguaucccagugcagguggauggggaggccuggauucagagaccaggcuuaucaaaauuagauacaagaacgcugcccagaugcugacaagagaucgggacuuugagaacucaaugaaaaugugggaauacaagcauacugaaauucaagcugccccucaaccccagcuggacuuccaggacucucaagagagccucucugacgaggaguaugcccagaugcagcacuuagcucggcuugcagaaaaccucaucagcaaacuuaaugaccugagcaagauccaccagcaugugucuguccucauggguucugugaaugccagcgcuaacauccugaaugauauauuuuacggccaagacaguggcaaugagaugggugcagcuuccuguauucccauugaaacucuaagcagaaaugaugccguagauguuacauuuagucuuaaaggucucuacgaugacaccacagcuuuccuggaugaaaagcugcugagaagugcugaggaugagacugcacuacaaagcgcccuggaugccaugaauaaggaguucaaaaagcuaucugagauugacuggaugaauccaaucuuuguuccagaggaaaaaucuucggacacugacaguagaagccucaggcugaaaauuaaguuccccaaauugggaaagaaaaagguagaagaggaacgcaagccuaaaucaggccagaguguccagaguuuuauuggcaauuuauggcaccgcagacaucgugaagaugaagcagagggugaugauccucuaacaccaucgagaucucaacuguagcccuugaaagcuggaagaacucacaacauugagaauucuacuaaaaaaacucucaaaaccucaauacaggcuagacuaaaucauuucagaacaaacaugagcaccaccaagaaagacccuccaauucuuuucacuaaugcauuuuccuggacuuaaucuggucuccuuagagguuuacauuuccucauuggccaaagguucuuguuccgaguugucuuguucaguucuccuucucuuugugcaucuugagcaacuacaguauuuauugggauaagcucuuuaugaauggccugggaucuauaaaggauucaagggaguucaccucuucagggaguuuuggaaugguuuucucugaccagcagagaaacuaucaaugcuaaggaaugaaugaaagacacacagacucccagggagaugaagagaagggggcaggcaggacagccagacuugguugugugucucuccgaaucccugccaacugcaacuugcaccuucaggagaucucuucuaguuggcucauuaaaaugagaacuagauccugggggcuuguccacuuuccuguuaagaugaccaugugaaaucucuuuuuguagauaugguaaccucucucucucucugcaaacccuuugcguuuuucuaugugugcuuguaugucugcauauguccagguggugcucuggugggcucauugguuggaacucaccccucauggcaaccauacaggcuccccuccugcugccuugauccuagccugcaugccuccacggaguguuugccugcauucuugcuggauuuuuuaacuaaauguuuugccgcugugcugcaguauagauuauguauagagacauaaagauguauauauauauacauacgcauauauauuuuuaagagcugaaaauacaacucgaccucuaagugacccuauaauuuauugugcuaauccaggaaucccuucccacucccccuuacucuacauaacaauaacacauacaccucuaccaacugcccuauuucuugguggagcuucuaaaucuuuuggugcauuuucagcgucuuagagguggcugggaucuauggcccagcugauucugacgcccccuuaaaauucugagccaggccauggaaaggggaacaaaaacaccaaugcccuaaagaagggguuuaagcuggcaugcugccuuuuuuugcucuaucuguccuagacucuucaucagcaacugugcccuuccccaauaaaaagacuauauggagcaaccaggccuugagcucugugacuuagaugccugaacuagggacugccugacaauuaagucacagccuaggcccuuccccacaagcuccaucuuggccugaucuucuggacaggcuguugggucaguccucaagucaccuucaaaucucccaucuugcccuuuucccuugaguacagaggggcauugaagugaucagaaaaaacaugggccuggagaaaugaaggcuagaagccugugcuuuccugugguucuucuugcaaauuucucaugaaaacaaacuauuccuaaaucgcuccaaauacuaauucacauuuuucaaaaaugccuucucccagucagggcaaaucuaaucaaaccccaaugcccagagagguucucucuggucagccuugcaucuucaccccacccuugacucauaccuuuaguuaacugucccuucccacuuaucaagagaaaacuggccucucccuacuucucagacaaacuuagcgugcucaauuaccugauucaguccaauggcugguucauugaggugcacaauucagauuccaagcacugguucucaacucuggaacuccaccagccuaacccacuuaaaccagccaccugugcuccaccuccgcaggggugaggagaaaaauauuaacaaggggauaguccccaaaugucugauugcugugccaaacuaaguccuagcucuacaacuagagaagaaagucaauggaaaaagaugacagaaaacauuuaaaacuuauuuaagcaucagaauguguuagcuuguuguacauauuugaguagugagugugcuguuguugugucuuugacuuucucuguuauuagucuuucuucccaggaggagguauuagaugaaaucagcaagcucacuauugcagccugacuuggcuccucuauggcugcaugcauugacaccugcacacacacucacagagugggaaccaaguugcauuuucuucagaagagcuuuuuccgaaggggaaaauguccaaaugagcaaauuuaggacuacagaaggaaguccugggagaagauagcuuuaucuuggcagugacuaagcagggcugugucuuauaauuauuuuuaucacugaugauaguaaacuguaauaagacuccaucucuugugcuuacuuugcugcaauaauuaggucuuugugcacagugaugcugcuguugcucuguugugccauguggauucccuuucaccuacccuguccucccacucugagucagaaugauauugacugaaaccacuaguauuuggggcuagagucagcucauggagcacaguugauagaugacaaggcccaggagcagguguggcuugcucaaucccucaguuaccuccuaaauugcuaaguuaccaguaguuucccaaaaaggaagauagcuugccaagcaccuguucuugcauaugcucacuuggaaacaaagcaagaagugaugccucaagggaguugucuuagcucugggagugugagcuccuuuaaggacuuuguuaaccacuugcaguaauuaauacaauugcuuggguggugggaccaaacaccaaauauccaucucaauuauguucagacaucauuaagacccaaagcucuaggguuugguuguaucuuugguagcacuuucugacgaauugguuggguaggcaauuccuggccagaagaauaguggagaagaaaaagccgauacauuugaacugccaccaacugcuucuggugucaauacuauaggagguaaacaguuauggguccccuucuccagaaaggcccugugcuguguccauaagagcagguuaagaauaagaaagagauuuuuuaccuuaauaaaacugggccagaagaaacagucagggucaacgucaucuucccucaggacacaaauggaagaauuuuucuuucacgagagguggaaaauaauaccaaagcaaccaaacccauuagcaccauuccauccuauaugagaccuugcuuggcuauaugauuuguggaauugcauuugucuauuugucagugaaucuguaacccauuguuguuuucugcucuguguuuuuuauuuccucagaggccccugcaaauaagcagcagggccaggggcugguugggggaggaagcugggguauuuacaugguaacaggaaaaagcagaaaaaaaagauccacaaagugugccuauuccucuccccccgccaaauggaacaccaguccucaauguuaauaaaguauugcuucuuuaaauauuuuaauaaauggauaaacauaa

SEQ ID NO: 1442 - RNA, 2825 nt, Homo Sapiens
agaaacccggguugaggcaggaggcggcuagaccgguggcggcggcaucuggaguagcacugagaucuuccgguggcgggaacugcagucauggaucauauuacgguacccaagcuugaccuauuaguuccuaagguagaaaacgugaaauugguggaucguuaugugaguaagaaaccagcuaaugggauucuuuaucuuacugcaacccaccugaucuauguggaggcuucaggugcagcccggaaagaaacauggauugcacuccaucacauugccacuguggagaaguuacccaucacuagccuggguuguccccugacccuccgcugcaagaauuuccggguggcccacuuuguuuuagauucugaccuugugugccaugagguuuauauuucacugcucaagcuuucucagccagcauuaccugaagaucuuuaugcuuuuucuuauaaucccaaauccucaaaagagaugagggaaaguggauggaaacugauugacccaauaucagacuuugggcguaugggaauacccaacagaaacuggaccauaacagaugccaacagaaacuaugagauaugcagcaccuacccuccugaaauagugguuccuaaaucuguuaccuugggaacggugguuggaaguucaaaguucagaaguaaagaacgugucccugugcucuccuaccucuacaaagagaacaaugcugccauuugccgcuguagccagccucucucuggauuuuacacucgcuguguagaugaugagcucuuguuggaggccauuagccaaacaaacccagggagccaguuuauguauguuguagacacaagaccaaaguugaaugccauggccaaccgagcagcugggaagggguaugaaaaugaagacaacuaugccaacauucgcuucagauucaugggcauugagaacauccauguaaugcggagcagucugcagaaacucuuggaaguuugugaauugaaaacuccaacaaugagugaauuucuuagcggccuggagagcucagggugguuaagacacauuaaagcuauuauggaugcuggaauuuucauuacaaaggcagugaagguagaaaaggccagugucuuaguccauuguucugauggaugggaccgcacagcacaagucugcucaguggcuagcauccuccuagauccauuuuauaggacauucaaaggacucaugaucuugauagagaaggaauggauauccaugggccacaaguuuucccaaagguguggccaccucgauggggacucuaaagaaguguccccuaucuucacccaguuccuagacuguaucuggcaauuaauggaacaguuucccugugccuuugaguuuaaugaaaacuuccugcuggagauucaugaccauguuuucuccugccaguuuggaaacuuccuugguaacugccagaaggaucgggaagaucuaaggugaauuuacuuugugagaagacacugaacagggagaagguggucagugcaaaaagaauguaccuaccacccugaauuuggcauagcagucaagaaaggggaggagauaacaauaauaaaaagaacuuuugaagcauaaagcaagucuaugagaaaacacauucuguguggccuuucuugguucagaggaaaccagacuucaggaacccucucuauaaaggcuucacuauguaugggguacucaauccuaguacugugcccuacaacauucaguucuggugugggauguauaaccgcuuugacaaagggcugcagcccaagcagaguaugcuagagagccuccuggaaauuaagaaacagagagcaaugcuggagacagaugugcaugaacuagaaaagaaacuaaaaguccgugaugagccaccagaagagaucuguaccugcucucaauuaggaaacauauuaucccagcaucugggaaguccuuugaccaauccucuuggcuuuauggguaucaauggagaccugaauacccugauggagaauggcacccuauccagggaaggaggccuccgagcucagauggaucaaguaaaaagccagggugcagaccuccaccauaacuguugugagauugugggcagccuuagggccauaaauaucucuggggaugugggcaucucugaggccaugggcaucucuggagacaugugcaccuuugaggcuacgggcuucuccaaagacuuaggaaucuguggggccauggacaucucugaggccacuggcaucucuggaaacuuggguauuucugaggccagggguuucucuggggacaugggcaucuugggggacacaggcaucuccaaggccagcaccaaggaggcagacuacuccaagcaucagugaguuaguuacucaucuuccaugcuagguauaccuacagcagcuacaaugauucuugucccagagagggcuaugcugcuuuuccaauugguuuaagugggugaagccagggcaccccucuccccacuuaagucuggaagggaauuacuuuacugauuaagugaccaauauguucauauuaagcaguacagaguguaggcaagagaaagaauauguuauuguucuaaaaugggauuuaacuauagaaauguugccucucagcugagacacauauuaagcugguucuacugucuguuuuccuuaaugaucgaccugcccuauuuucuauccucacugcaguaaugugaaagugaaguggaaauauugucacaauggucaauaaugacccuuuugaggguauggagagaugguauacagcagguaacugugaauugcagaauaaauugaaagaaaauuuua

SEQ ID NO: 1443 - RNA, 7543 nt, Homo Sapiens
aaaguugcagcuuuuuccgccucccgggagggugagaagggccggcugccggagcuggguugcgaucuucccggagccggagacccucccuugaaaccggcacugggacuucucgaucucuggaggcaccuguugcaagugacagagucaccuuuucguggguuccucucacagcgcucggccgucgagcggggucgcuaacccgcacucucuucggaccuacgacaucgcggcuucucuggcguuggccagucagccacagguaaggaacuaguaaaaaaagaaaaagaaaaaauaaagugaaagaggcguguugucuaguuucaaaggagaggagagaagguaagugugauucucauuuccuuuuucacucucugucuaccuugggcucuuugacucccaugacuaccaaguguauauuaucagagacugagucgcccuguguugcccaggcuggucuugaacuccuaggcucaagagauccuccugccucagccucccaaagugcugggauuacaggcaacucugguagcucuccuugucugguuguuuugaagaaagaagaguagaagaaaaaguugaguaaaucaugucggaguuacuggaccuuucuuuucugucugaggaggaaaaggauuugauucucaguguucuacagcgagaugaagagguccggaaagcagaugagaaaaggauuaggcgacuaaagaaugaguuacuggagauaaaaaggaaaggggccaagaggggcagccaacacuacagugaucggaccugugcccggugccaggagagccugggccguuugagucccaaaaccaauacuugucgggguuguaaucaccuggugugucgggacugccgcauacaggaaagcaaugguaccuggaggugcaaggugugcgccaaggaaauagaguugaagaaagcaacuggggacugguuuuaugaccagaaagugaaucgcuuugcuuaccgcacagguagugagauaaucaggaugucccugcgccacaaaccugcagugaguaaaagagagacagugggacagucccuccuucaucagacacagaugggugacaucuggccaggaagaaagaucauucaggagcggcagaaggagcccaguagugugcuauuugaagugccaaagcugaaaaguggaaagagugcauuggaagcugagagugagagucuggauagcuucacagcugacucggauagcaccuccaggagagacucucuggauaaaucuggccucuuuccagaauggaagaagaugucugcucccaaaucucaaguagaaaaggaaacucagccuggaggucaaaaugugguauuuguggaugagggugagaugauauuuaagaagaacaccagaaaaauccucaggccuucagaguacacuaaaucugugauagaucuucgcccagaagaugugguacaugaaaguggcuccuugggagacagaagcaaauccgucccaggccucaauguggauaugguagaagaggaagaagaagaagaagacauugaccaccuagugaaguuacaucgccagaagcuagccagaagcagcaugcaaaguggcuccuccaugguaaguucuauuagaucugugguuacaggcauguugggguacuaggaagaaaagaagcaccucccuagagcagauucgggaccuggggaaaccauccuagucacucuuuucagguaaguaagaucauuuguuuguuccuauccucaauuuagacuauaggugcuuaguguacaucuaggugacuuccugagcccccaccuggagauuauuacauuacagcuugggacauuuuucaucacagcuuugugaacaauaaccuuaacuuauccucuaaagggguacccaggcuaugaagugagcaagaucagauuucuucaucauagcccauuccaaauucucaacauuaaaagaaagugagugucaugagaggggcucuggcaggguugaucgacaucaggguaugguuaacaagcaauaauaccagucaggauaaugaauuuaaagggaacauuuaagaaucagggccugguucugucauaagcaugaagauugauauuuagggaaacaggaacaagggugaacagaauuuguucacacucacacacaggaagagaaugucagcucgcaugaccgauuacuaccagaaaggaaggugccuuuucacuucuggugggguuuccucccucccacucacucccaguucuggccaaaucucuuuucucuguaggcccugauaagacauaagguggauaagagaaacccacagauaauuaaggcaccuuguuuuaguuaguaacuaacccccuucuagcugguguuuuaguguauauaacacauuccccagauggacuuaacugcaccuugccucugcucccugcccaccuccuggggcaggugaaaaugaacacuaaaauuuguaaaaagaguugaggaagagaagcuaagaggcuaggugagccaugagcugauucauucaccugaacaauuuugagugcugguaguucucucuuacccucugggucaaggaaugucagcagcacuggcuuauugcaggggcuucugaaacuucuguucagugacugugguuuuaucaugagggaagaugugagcaaugcgggcgggggagugugccuuccccagauguucgugggugcuuuaucuucagaguacgaucggcagcaugaugagcaucuacagugaagcuggugauuucgggaacaucuuugugacuggcaggauugccuuuucccugaaguaugagcagcaaacccagagucugguuguccaugugaaggagugccaucagcuggccuaugcugaugaagccaagaagcgcucuaacccgugagugcuucuggaaccugacugaugcucugagaccagagaccagaccccggcaucuguccgggcacucuugaacagagcuuaucuguuucugggggagcagggagguguaauguaggaaaagaaccaggauugggaaaaagcaagaauggcaugucuaagagggcuugaggugacauuuuugacaucacaugucaccauggcauaucuauauggagaggaggaaagugaaaagcaggcuugagaaaggccagcaaauuacucagugcugucuuugguuucuagauaugugaagacuuaccuucugccugacaagucccgccaaggaaaaagaaaaaccagcaucaagcgggacacuauuaauccacuauaugaugagacgcugaggguaaguaucuagaccucaaggguaggagaacuuguucugucuugugcccuaagcuguagcuauuccucugcaacaugaccaggugacacgggcuucagugggccaugucugugucugaggauacauuggguaucuguucacauccugaucucccagugaagagaacaaaggugaucugccuuuccuggauugaugugaaguuugagauucacauggccacaaaucucauguaaaaaagacauuugagauaaggagucuccuuggcaguucuuuuuggacaauccaguguuaucucauccacuuaagaaaaaaugaauuuuccagguccuccuauggaauaugguagguuuuuauaaaaugaguuaaguugaggcuuugagugaggaaacucaaagugcucagggaacauaaaguaauuugguauucaggacuagugacuucaggaaugguugcucagguuuuggaauaaucuugucugaagaauuacccuuaacuaaucaucuugggcuuuuacuuucccuucacaguaugagaucccagaaucucuccuggcccagaggacccugcaguucucaguuuggcaucauggucguuuuggcagaaacacuuuccuuggagaggcagagauccagauggauuccuggaagcuugauaagaaacuggaucauugccucccuuuacauggaaagguagucugcuuuaacaacuccugcaguuuggaucugagguagaauugucugcaguagccucugcuggucuauguugguagcgucuuugaauguagucuucucuggaguucuagugcccccugcugguguuucugaguuugacagcaauuucagaggcauuugucuaucaagugugaguucuguguaaaccaggcaaagugugaagccaugguuuugcuuugaaaaaauuuucauauguguaccaaacuuugucuccuaaccuuccagaaucuggguguauccuaacauccuaacucgcaccucuucuccgagcuaaccuucuguguauauccuaaucuguacccuuuugccaagccacugcuuuacuuccaagugggaaguaaagcaauucauggagcuccaauugcuaugcucuugguuacagaggccagggaaauauuacuuuggagauggcaccucgggccacaguguagcaguauggcauaaucaugccugggaucugagugcagaccuguguuggaauccugguucugucacuugccaacuagaugagucacuuaacuacaaaauaauguagggaaaucaucuggcuaagaagaaauagcuaaaacagaggacuuauucagcaacuucuugauuaucagaacuacacaaugacaugacaaaguucaucuuauuuuuuuuuacacuagcguuuuaaaugugggaugguuuuacaugguccauagacuuugggaaguuagaugagaaacuagucaugguggcugccucuaggaauggagacugagguagaaggaauauuuaguuuucucuauauccccuuuuuaagcauuugaacuuuuuaccauauuaagaaaauuaagcaaaaauggacuuauguacacaugauucaaaauuaaaacaacauaaaguauauuaaaaggaaaguagguuccauuccuuagaaauaaccaguguuaacacuacuuguguauccuucuagaaauuuuuuauggcuagguaugguggcucacgccuguaaucccagcacauugggaggcggaggcaggcagaucaccugaggucaggaguucgagaccacccugaccaacauggugaaaccccgucucuacuaaauacaaaaaaauuagcugggcaugguggcgcaagccuguaaucccagcuacuugggaggcugaggcaggagaaucgcuugaacccaugaggcggagguugcagugagccgagauugcgccuuugcacuccagccugggcaaaagagugaaacucugucucaaaaaaaaaaaaaaaaaaaaucagugcugaguccccgacuggcuugccaucacacaaaggcgaguuggugguuucauugaaauacaucccagccuccaaaaccccuguuggaggugaccggaaaaagaguaaagguggggaagggggagagcuccagguguggaucaaagaagccaagaacuugacggcugccaaagcaggagggacuucagacagcuuugucaagggcaggugaaugaucuaguagagguagugggaacucugcuucagcagauucaaggaggggcguguguaguaggaucuggauguggguucaucuucuugggcuaggccugugguaggggaaaggggaauuuagagagauaacuguccgcuuugaguaggcuguugauuacuccccgcccucugccagauaccuccuucccaugaggaacaaggccaguaaacguaaaacuccugugaugaagaagacccugaauccucacuacaaccauacauuugucuacaauggugugaggcuggaagaucuacagcauaugugccuggaacugacugugugggaccgggagccccuggccagcaaugacuuccugggaggggucaggcuggguguuggcacugggaucaguaauggggaagugguggacuggauggacucgacuggggaagaagugagccuguggcagaagaugcgacaguacccagggucuugggcagaagggacucugcagcuccguuccucaauggccaagcagaagcuggguuuaugagucccuguccucuucugcagguccagcccuggcgagggcaggucagaggaagugaagaaaucaagagcaaagauuuauaauuuaauguguauguguguauguguguauguguguguguguguguguguguguauguguacaaacauguauuuucugcaaaucucauuaugcuggcuagagugaugcagacuuguucuucuuuuuaaagcagucucaagaauaagcauuucuuuaaaauguuucuguguauaaucuaguuuauuuucagaguccauuuuuucuuaugucuuuauaagguucacuuaacuuaaaaacagcuuuuaaaacaacuuuuuaucuucugucuugcuaucauuguuccuacuucccuaggaagcccuggcuaccuuucgcauuaggaccagucuggguuuuaaggcucugggaagcaggguugguuaguaaagacaggaauguuggggagaggugaguaguuccuuccucuuucuccucuccaauuuaugcuuuuaacuuauuuucuaccuggauaaacuucuggaacuuggcuuuuaaauuuaacuuuucuaguuuuuaagcaguuuccaccuugcuuuggucuaaugcuuuucuuugaaaugcuaacagaauucccaagcuuuuuccaguucuagauaucuuuacuagaccuuugggggacucuuauaauggagcugcuuuugaaaagcacuuuaauuagauaauguauuuugacuaaaucacgaggaugcccagugagagcuucuagcugaucucagaggaccagagugacugaggguaaagugucucacagcccaugcugaauuuucugcauuuuaaacugauacugcagucauuggagagagagcuccucauuucucgaaugaaagaugagauauauucauccucauguaccacaucugucuuaguguuugcgucugggguguguuaucaaacagagcauggucuacaucccacugugucaaccagaagagccaaguguuaucucaauuggcccaguguuucuccaggcuggggacuguuaagggcucuaagggaauguagacagagucucccuguuauucugacuuccugcuugaugagcuuucaguuccuguuuuugcuauuguuuccuaaauuugaccuacauauuacauggguguaguguguugaggcuuuucaaagaagggucuagugagcuaaguuucaucuucugguacucauugaucaaacugaccuuucuauucucauaagcguuucuacccaaaguuguguguggaaggaguguauagcagagaggaaaucccuuucaacagagucagcugcuaacugauuuccuauaagcacacuggauuaagggcagccacagugguuucuacuguauguaugaaccgaauggaggaauguuuucaaagauugauuugguguggauugcaauuguaauggaaggcauaacuugggaucccgggcuguaacuugcucuuuuguuucccaccccccugacauguaugugugcuuuaauaaagcuuucucacuugucaaa

SEQ ID NO: 1444 - RNA, 685 nt, Homo Sapiens
ggcggggccugcuggguggcuuagcacugcagggcucugcgcgggaacgcuaaccugguccggagcgagucugggucucagccccgcgaacagccuuucacgagucuucaagcuuucaggcuaucuucuagucaagaugagugauaagccagacuugucggaaguggagaaguuugacaggucaaaacugaagaaaacuaauacugaagaaaaaaauacucuucccucaaaggaaacuauccagcaagagaaagaguguguucaaacaucauaaaauggggaucgccucccaacagcagauuucgacauuaccugagagucuugauuuuaggcuuguuuuuuguaaacccauguguuuguagagauuuuaggcgucuucggauaucuucucaccuauguucccuggcuaagaagucagagguagccaauguuuccuuaaauucauuuuuaaacuuaccauuggugcauauguuccagauggcagaugcugucaauaaucucaccauugaugaccuuuguguauguaguucuugcauccuauacuggauaagccuguuuuaaccugcuaugaugggugcuuccauugcuucauaaucuucaugaaguugcaugcuuuugcagcuuuucacaguuuauuugcauuucuaauguaguaauaaaguaaccaauauaaucauuaucuuga

SEQ ID NO: 1445 - RNA, 1379 nt, Homo Sapiens
gggagagagaucuuccucucucuucgggcguguuaagacagcgggguuggccuguacuuccucuggcccuggcugaagagggcuagugaaaccguuaaaccccuaggcgaucauggccuugagaccugaggaccccaguagcggguuccggcauagcaacgugguggccuucaucaacgagaaaauggccaggcacacgaaaggccccgaguucuaucuugagaauauauccuuauccugggagaagguggaagacaagcugagggccauacuggaggacagcgaggugcccagugaggucaaagaggccugcaccuggggcagccuggccuugggagugcgcuuugcccacaggcaggcacagcuacaaaggcacagggugcgguggcugcacggcuucgccaaacugcacaaaucagccgcacaggccuuggcaucagaccugaagaagcucagggagcagcaggagacggaacgcaaggaggcggccucccggcuaagaauggcccagaccagccucguggaggugcagaaagagagagacaaggagcuggugucuccccaugagugggagcagggggcaggguggccaggccuggccacugccggagggguuugcacagaaggagcagcugaggaggaagaagaggcggcgguggcugcugcuggugcugcuggaggaaaaggagcagaagaagagcagaggggauguuggagguuguggcugccccuguggaggccauggcucccccuguggaggcuggggcugcccccauggagacccaguucccccacguggaggccagggcugccuccauggagaccacagagaagcuggagagaauccuccugcagcuccuuggagaugcugaucaggaaaaguacaccuauugggggcagaaggagggagaucuccggucggucgaaacagccacaucuuauuucucuggaaccacgaaccccugguccagagccucaucagaaccucuuccuguccagcucccugccucauacucauacucauacucaagcccuuuuuccuccuucucagacauacccacuauauccccuccacaagcaacagucacagcaccaguuccgccucagcugccuuccgacugggaggccuuugauacuagccuguggucugauggggggccccacagaauagaccaucaggagcacccaagagacaggagauacuccgaaccucaucagcaaagaccuccaguauaucgcaggccaggggacugggacugcccuugguguaacgcugugaauuuuucacggagggauacuugcuucgacugugggaagggaaucuggcugcaaaaaccucauugagugcagaaaugcaaaauagaaccgaagcauguaua

SEQ ID NO: 1446 - RNA, 1843 nt, Homo Sapiens
cacacacacacacacacacacagagcugcuuuguccgcugugagguuggagguuuggggacucugugcccacuaagcuacuuucuauuucaagugccuguaugucugaggcuggguuugaagccuccagcguguuuggaguuaauccccauuagguuggacuccgccccuuucucccaaagguaaagcaagguuuucaggcaucacugcaaagggcagcuaguauucccauccuugucuaacaagcuguaaggagaaguuguuucugagaucugagccugaagagagggaacaagucagucagccuucguggucagaagagaaaccugugaccaugaggagcagccugaccauggugggaacccucugggccuuccugucccuuguuacugcugugaccaguucuaccaguuacuuccuaccuuacuggcucuuuggaucccagauggggaagccagugucauucagcacauuccggaggugcaacuacccugugcggggagagggacacagucugaucaugguggaagaaugugggcgcuaugccagcuucaaugccaucccaagccuggccuggcagaugugcacaguggugacaggugccggcugugcucugcugcuccugguggcacuagcugcuguccuggguugcugcauggaggagcucaucuccagaaugaugggacguugcaugggagcagcgcaguuuguuggagggcugcugauaagcucaggcugugccuuauacccuuuaggauggaauagcccggagauaaugcaaacaugugggaaugucuccaaucaauuucaguuagaugaaaaagguggaagauaaaauaauuuaagaaguccuauuuuguccagcauaggggaaaagagaacacagcuuuguaccugucggcuuggcugggccuauuacugugcuggagguggagcagcugcagccauguugaucugcaccuggcucucuugcuuugcuggaagaaaccccaagccugucauauugguggagagcaucaugaggaauaccaauucuuaugcuauggagcuugaccauugccucaaaccuugagcuuugaaagaagauuggagagggugggaaaggggaggagggagcccugaaaagagguacuaaggauuaggccauuugucaucugacugucauuagcauagccuaguguuugcaugcuuuuuaaacuaauugucguucauuuucacuuaucuuuaagccaguaggucacuggcuguuuauaaaauucaucagaggaaacauucucagacauuuacccaacuggcaagucgugcuaacccgaagacccaaaguaccccuuuaugcaaaauaggauccaaagcuaaggcuggguaagaauaguugugcagggagggagcacgagaugggcagagcugguuccuaccacuccauucacacaguucaucaguucauucccaaguauuuauugucacccccaaacaucucuggaguacuacugcucaauuuuugugucguuaucaggaguauaccuuggcucuuccuuuuuuucuccugcuuccccccgcaccuuguggggaagcuucaggggagcgggggagggugauucccagugguggggaaaacauuaaucaaggauacuugcauuuagccuggagccccuuccucauuaugcuuuagaauauucauaggaguuccauuuguauucuggcugggugaugagcaaaaaaaauauauaguagcaaauauucucucauccuuuagagauaaagaaaugguguucaucaaauguacugagaauagacuagcauuuguggggcacucaauaaauuuaaauucauggugacagugacaa

SEQ ID NO: 1447 - RNA, 84 nt, Homo Sapiens
gaugcacccagugggggagccaggaaguauugauguuucugccaguuuagcgucaacacuugcugguuuccucucuggagcauc

SEQ ID NO: 1448 - RNA, 682 nt, Homo Sapiens
auuaaacauggagaaaugaggagcggcggcagaucgguuugggaugcaucuucaggggaugcugaaacaacagcagcauuugguuugcucuacaccccugccaccccucgcccgcaagcccagggaguggucagcaguggggcuuugugacgucgaagccacccuagggcugccauuggcugggacacugccuguaugaucaaacaaagcucaaggguguggcuuugccuugucaccaggaggguauacauagggagggcaagagcuccgggccacugagaagauucaaaaccuacaaaagccugccgcugacauugaagaaccaauauauacaauggacaaacaauccagugccggcggggugaagaggagcguccccugugauuccaacgaggccaacgagaugaugccggagaccucgaguggguacucagacccgcaaccugcuccgaaaaaacuaaaaacaucugaguccucgaccauacuagugguucgcuacaggaggaacuuuaaaagaacaucuccagaggaacuggugaaugaccacgcccgaaagaacagaaucaacccccuccaaauggaggaggaggaauucauggaaauaaugguugaaauaccugcaaaguagcaagaagcuacaucucucaaccuugggcaaugacaauaaaguuugagaagcuga

SEQ ID NO: 1449 - RNA, 124 nt, Homo Sapiens
gccaccaccaucagccauacuauguguagugccuuauucaggaagguguuacuuaauagauuaauauuuguaaggcacccuucugaguagaguaaugugcaacauggacaacauuugugguggc

SEQ ID NO: 1450 - RNA, 1963 nt, Homo Sapiens
uuccaggauaugaacucuacagcggaagaauaagaaaccggaacuaaacuucucacucaucugacuuccugcgguuuacgacaacagacuuugguugcaccggaaaagaacagauucucuuccgucgcagaguuucgccauggcacuguggacgcucucuugacggaugcuagggagacccgccaaguuuucaaaggcccggggccccaagaagcacuuaaagcguguugcagcgccgaagcauuggaugcuugacaaacuaacggguguauuugcaccucguccaucgacagguccccacaagcugagggaaugucuuccucugaucgucuuccucaggaauagacucaaguaugcguugacuggagaugagguaaagaagauauguaugcaacguuucaucaaaauugauggcaagguucgaguggaugucacauacccugcuggauucauggaugucaucagcaucgagaagacaggugaacauuuccgccuggucuaugacaccaagggccguuuugcuguucaccgcaucacaguggaagaggcaaagauugagauuacaggcaugagccaccgcacccggcaaaagccacauguucuuagcaguucuuaguagugguagaguuaaguuugucucuggggcucuuuguuaccaccgcuccagaguugcccauugaggacuaucaauuggaaauaugucccugaggaaaaaaugauauaccaguugauuguguguuaccacucagauacacaggcaacaggcuuuuagccugugauaaaggaccagagguuaguucagcugagcacucuuccagcagccaccagaggguucugaaacagauucccccuuggcaagguuucccaaaugucuaaauuacuaaaucaguaugggagaucaucagcucugugacugguuaauauaguuuuucccaagagcacuccuucucugaccgaggaaaugcuggaaaucgaugggauaaguaaugucugggugacugcuuuaggcuggcuuuguguuuacauauugaauugauuuuccuugcuguguuuauaguacaaguugugcaaagugaggaagauuacugugggagugaagggaaucccucaccuggugacucaugaugcucgaaccauccgcuacccagauccugucaucaaggugaacgauacugugcagauugauuuagggacuggcaagauaaucaacuuuaucaaauuugauacaggcaauuuguguauggugauugguggagccaaccucggucguguuggugugaucaccaacagggaaagacauccugguucuuuugauguggugcaugugaaggaugccaauggcaacagcuuugccacgaggcuuuccaacauuuuugucauuggcaauggcaauaaaccuuggauuucccugcccaggggaaagggcauucgacuuacuguugcugaagagagagauaagaggcuggccaccaaacagagcaguggcuaaauugcaguagcagcauaucuuuuuuucuuugcacaaauaaacagugaauucucguuucuuaagcuguaaaaacaaaaacaagccaaacaagccagcaagcaaacaagaagaagaaaacaacaacaacacaaaccuugaaauagacuugucagauguaaauauuucuuuucuagggaaauagaagguguacaguggaguuuucuggaggcuacaugacaugugauaagaaaacagacugaaaaagggaauacaucuauaaagagaaaauugcuaucacuguuuuugguugggaaaaacauuuguaugagauaaacauguuauucuuuucauaaucagacauucuucucacaaguguugguucucuaccauuccucaaaggugauaauuuuuugaaauauguuauuguggauucaugauuuuggauauauccaauggguuuaagugcauugcaauaaaaugguauuuugauacuca

SEQ ID NO: 1451 - RNA, 152 nt, Homo Sapiens
gacuuuuagcgguggaucacucggcuccugcguugaugaagaaugcagcuagcugugagaauuaaugugaauugcaggacacauugaucaucgacacuucgaacgcacuugcggcccggguuccucccagggcuaugccugucugagcuuug

SEQ ID NO: 1452 - RNA, 4371 nt, Homo Sapiens
agggggcgggugugcugccacccauuggcucaggccgauaccacgcgccccgauacccggcacaggagccaccucccagagccccgcaguccaugccucagucggccugcgcuccucagccuggcgguucuaccuccgaggguucgcccgcccuugguuuuccuuacaccuuagccuuuggcuccuuugaccacucgaagccccacagcguguuccagcggacuucaccagcagacccagaaguggugggugaaacacugccucuguuccuccuugagccugucgggagcugcugccugccaccaccaugucugcugcaaauccugagacuccaaacucaaccaucuccagagaggccagcacccagucuucaucagcugcagcuagccaaggcuggguguuaccagaaggcaaaaucgugccaaacacuguuuuuguugguggaauugaugcuaggauggaugaaacugagauuggaagcugcuuugguagauacgguucagugaaagaagugaagauaaucacgaaucgaacugguguguccaaaggcuauggauuuguuucguuuguuaaugacguggauguccagaagauaguaggaucacagauacauuuccaugguaaaaagcugaagcugggcccugcaaucaggaaacaaaaguuaugugcucgucaugugcagccacguccuuugguaguuaauccuccuccuccaccacaguuucagaacgucuggcggaauccaaacacugaaaccuaccugcagccccaaaucacgccgaauccuguaacucagcacguucagucugcugcaaauccugagacuccaaacucaaccaucuccagagaggccagcacccagucuucaucagcugcagcuagccaaggcuggguguuaccagaaggcaaaaucgugccaaacacuguuuuuguugguggaauugaugcuaggauggaugaaacugagauuggaagcugcuuugguagauacgguucagugaaagaagugaagauaaucacgaaucgaacugguguguccaaaggcuauggauuuguuucguuuguuaaugacguggauguccagaagauaguaggaucacagauacauuuccaugguaaaaagcugaagcugggcccugcaaucaggaaacaaaaguuaugugcucgucaugugcagccacguccuuugguaguuaauccuccuccuccaccacaguuucagaacgucuggcggaauccaaacacugaaaccuaccugcagccccaaaucacgccgaauccuguaacucagcacguucaggcuuacucugcuuauccacauucaccaggucaggucaucacuggaugucaguugcuuguauauaauuaucaggaauauccuacuuaucccgauucagcauuucaggucaccacuggauaucaguugccuguauauaauuaucagccauuuccugcuuauccaagaucaccauuucaggucacugcuggauaucaguugccuguauauaauuaucaggcauuuccugcuuauccaaauucaccauuucaagucgccacuggauaucaguucccuguauacaauuaucagccauuuccugcuuauccaaguucaccauuucaggucacugcuggauaucaguugccuguauauaauuaucaggcauuuccugcuuauccaaauucaccauuucaagucgccacuggauaucaguucccuguauacaauuaucaggcauuuccugcuuauccaaauucaccaguucaggucaccacuggauaucaguugccuguauacaauuaucaggcauuuccugcuuauccaaauucaccauuucaagucgccacuggauaucaguucccuguauacaauuaucaggcauuuccugcuuauccaaauucaccaguucaggucaccacuggauaucaguugccuguauacaauuaucaggcauuuccugcuuauccaaguucaccauuucaggucaccacuggauaucaguugccuguauauaauuaucaggcauuuccugcuuauccaaguucaccauuucaggucaccacuggauaucaguugccuguauauaauuaucaggcauuuccugcuuauccaaguucaccauuucaggucaccacuggauaucaguugccuguauauaauuaucaggcauuuccugcuuauccaaguucaccauuucaggucaccacuggauaucaguugccuguauauaauuaucaggcauuuccugcuuauccaaguucaccauuucaggucaccacuggauaucaguugccuguauauaauuaucaggcauuuccugcuuauccaaauucagcaguucaggucaccacuggauaucaguuccauguauacaauuaccagaugccaccgcagugcccuguuggggagcaaaggagaaaucuguggaccgaagcauacaaauggugguaucuugucuguuuaauccagagaagagacugauaaauuccguuguuacucaagaugacugcuucaaggguaaaagagugcaucgcuuuagaagaaguuuggcaguauuuaaaucuguuggauccucucagcuaucuaguuucaugggaaguugcugguuuugaauauuaagcuaaaaguuuuccacuauuacagaaauucugaauuuugguaaaucacacugaaacuuucuguauaacuuguauuauuagacucucuaguuuuaucuuaacacugaaacuguucuucauuagauguuuauuuagaaccugguucuguguuuaauauauaguuuaaaguaacaaauaaucgagacugaaagaauguuaagauuuaucugcaaggauuuuuaaaaaauugaaacuugcauuuuaaguguuuaaaagcaaauacugacuuucaaaaaaguuuuuaaaaccugauuugaaagcuaacaauuuugauagucugaacacaagcauuucacuucuccaagaaguaccugugaacaguacaauauuucaguauugagcuuugcauuuaugauuuaucuagaaauuuaccucaaaagcagaauuuuuaaaacugcauuuuuaaucaguggaacucaauguauaguuagcuuuauugaagucuuauccaaacccaguaaaacagauucuaagcaaacaguccaaucagugagucauaauguuuauucaaaguauuuuaucuuuuaucuagaauccacauauguauguccaauuugauugggauaguaguuaggauaacuaaaauucugggccuaauuuuuuaaagaauccaagacaaacuaaacuuuacuggguauauaaccuucucaaugaguuaccauucuuuuuuauaaaaaaaauuguuccuugaaaugcuaaacuuaauggcuguaugugaaauuugcaaaauacugguauuaaagaacgcugcagcuuuuuuaugucacucaaagguuaaucggaguaucugaaaggaauuguuuuuauaaaaacauugaaguauuaguuacuugcuauaaauagauuuuuauuuuuguuuuuuagccuguuauauuuccuucuguaaaauaaaauauguccagaagaggcauguuguuucuagauuagguaguguccucauuuuauauugugaccacacagcuagagcaccagagcccuuuugcuauacucacagucuuguuuucccagccucuuuuacuagucuuucaggagguuugcucuuagaacuggugauguaaagaauggaaguagcuguaugagcaguucaaaggccaagccguggaaugguagcaaugggauauaauaccuuucuaagggaaacauuuguaucaguaucauuugaucugccauggacauguguuuaaaguggcuuucuggcccuucuuucaauggcuucuucccuaaaacguggagacucuaaguuaaugucguuacuaugggccauauuacuaaugcccacuggggucuaugauuucucaaaauuuucauucggaauccgaaggauacagucuuuaaacuuuagaauucccaagaaggcuuuauuacaccucagaaauugaaagcaccaugacuuuguccauuaaaaaauuauccauaguuuuuuuagugcuuuuaacauuccgacauacaucauucugugauuaaaucuccagauuucuguaaaugauaccuacauucuaaagaguuaauucuaauuauuccgauaugaccuuaaggaaaaguaaaggaauaaauuuuugucuuuguugaaguauuuaauagaguaagguaaagaagauauuaagucccuuucaaaauggaaaauuaauucuaaacugagaaaaauguuccuacuaccuauugcugauacugucuuugcauaaaugaauaaaaauaaacuuuuuuucuucaaaugug

SEQ ID NO: 1453 - RNA, 1340 nt, Homo Sapiens; identical to SEQ ID NO: 1438

SEQ ID NO: 1454 - RNA, 2656 nt, Homo Sapiens
augucggcgugggucggaaagcaugcggaaguccugcuuugcuacgugauggauuugcaggucaggcuggggagccugggucugugggaggaguccagugucugagaucuggcagguggaggaacucagccaucccgguuaccgguggcaggaugauuuccuuucaucccaaccuuuauuuccacagugaaaucaucaugaaggagcacuguguuggcauccucggcuacagggugucucauuccacugcaguccagcgguucugggaucacgaaggucaagccuccagcugcaggcaguacaccuccuaccugagcucauucagcuguuuggcugaacaugacugcccggguuuuggcaggauugcugaguuggagucucacugugucauccaggcugcagucaaguggcaaacucucagaucacugcaaccucucccuccagcuucaaaggauuccucugccugcugaugcuguuuuucccccacaugaggagaaccugcagacaguuauaaaaaauucugugccugggguacucucgcucuguagaccaggcuggagcgcaguggcaggaucucagcucaacacauccuccgccucccagguucagccucugcaguagcugggauuacaagcaugcaucaccacgcucagcuaauguuuuguauuuuuaguagaagccaggcuucaccauguuggccaggcugcucuccuacuacagaucucaggugacccgcccgacucagcuucccaaaauccagagugcugggaauacaggugugagccaccgagcccagccaacuccaguauuuuuuaccuaagccaguggacgaguggaguugccuuuauuuuuuuuuuucuuuuuucagucauggucucgcugugucauccaggcuggagugcaguagucugaucuuggcuuacuauacaaucucugccacccauguucaggugguucuccuaccucagccucccaaguagcugggaccacaggaaagugccacuaggucuggcuaauuuuuguauuuuugguagagacagcuuuuugccauguugcccaugcuggucuccaacuccugaccucaagugacccaccaaccucggccucccaaaauguagaaauuacaacaagagccacgaagccuggccuggaguuguggcuuuuugacauaagaaaucuguggagggaaaagcuugguuugugggagcaccugagcucaguuuggcucaaagguuugggauaccuauuauugaguggcagugaugguauguuguuaaugcacaauauguuccuguauauagcauaugucuaugcucaucagauauuuucagguaaaaaaagauagucauuccaguaguuugagccauuauagcaauuuccaccaggggauuucacaguccaauuccaguugugggcaacagugauuaacauaaugguaauuaaugagaagagauuuugagacguccagccacguuuccaugucagugccuuguuugcaguauuaugaagaaagagugcauuggacuagauacuaagaaaaacauugaauuauuuuucuugccucuauaacaucaaaggacaauuagagauauagaaacuauggaacauuucacagcauggcuugacauuucacugaacuuuuauccuuuuaaccauguacaaaguuuguuaccuaugcaaagguaggacugcaaaaggaagacagagguggagucagaggucacaauccacagcaaggugacacucuuguugaucgcaccuugaaagccaaauuagagcgagaauuaacuuuccgguugccguaagagaacaaggagaaugaagcuaccagcaguuaacaguauuggauuaauugaaaugaagguggacagauuuuuuuggcuuuccaucaaauugaguaaagaaaagguaaccgcuuaucuaauuucacacacauacaauuauggauuaauuaaaagauuacacaacccauauauuauggguuucucauauaaguguauauauacaugggcaaacucacagugugccaguaugugucuauauccaaauauauacaaauccauguccaacaguuagcaagugagaaauucucuuccauuucaccauucccuuuccuagaauuuuuucauaaauauaauuuuuccauauauuugaagccuacucucuggaggcauguaaugcaugcaugcaguaaaccugugcgauaucacaauguuggugucagagaaaacuauaacaccgauguuauaaaagauuaauugugaggagaaaguuaugcuucgcauuacuacaaauacacaaguaugauuucauccaaagcugaaaucagucaauauaauuuguuuuuaauguuuuauuuaaaauccuuaauuucaacaggauuacucaagaaaaauaacguuauugguauuaaauaauguugauguauucccuuuaauuguugauuauuuaaaaugucaguaaaguaguaaauggcacuguacaauguaguuucaugaagcauucuuuauacuuuucauaaaauugauagucuccauggaauauuuuaagacugaggaaguuccauauaucauuugauuguacuuucacuuuauuacuugcuugcaugucauaacugauggaaauaaaacuauguauauuuacaaauaugaaaaac

SEQ ID NO: 1455 - RNA, 317 nt, Homo Sapiens
ggagguccuccuccuacaaaaucugcuccugugacaagaagcaauagucggaugggaggccaagaucgacgaagugauuggauugaggcugacauuccuuuucauccuguguugcuagcagauucaucuuaauuuuucuaaaagcuccuagaaguauucuuugaugggaccucucauggugcaccaccugcacaagggccucggaugucuuaugguggaagaagccgccauuauuauaacaauacacgagauagauauagcagaagucggagaguuacucaagacacuguggugauuuuuauuccuguuuucaugag

SEQ ID NO: 1456 - RNA, 1645 nt, Homo Sapiens
ggggcgggccaauggcugugacggauaagggguguggggugcggggacaaugggccagagcuucucaugcagccugcaccagcgccgggucggagagucagaggccacccugagauggaccgagaucuucaguuggggaggcgccuccggugagcuugcggccagaugcccccucaguaguccuccgcaacaggugccgcgcagccgaguggcgggcuagcauaccgccugcccgcaauucggccaggccucgagccugcuccgccuucccgcugcgguagcgccgccggggaaacgccgccacgggcugcaugggcagcgcucgcgccccgccgcugagccgccggggagccguccagucuucgaaucccagaggaaagcggcggcgguggcggcuucaacagcagcucuugcccuuaaggaacaaugaaacacaaagauggugcagacccaggcccugcuuugacugggagaaagaugcauucaguugacuaaaacuugaacggucggcuccaccagugcaaggauugugccuguccucuucccgggcugaucuuccccugugccuggaacagcaccugcuauauaaauuaugugcuggauacacacacucgaaaagcaagagaucaggcucccugagaaacagggcaguuuacuucuauagaagggugcacccucacagauggaccaaugugucaggagaauucagucacacccaaagcaggagguaauaagacaccgaagugaggacuucacaggcugcuugggagaagacaaucauccgugggcuugggaaagggagaaaugccuacugaguuuagggaauugcuugcuggaagaaaugaugaugcgggaggccagaugcgcaagauggacacucggcuccuccuucguccccgccucuccucgcuuccaggguagcagccucaacaagggaaacuauuguuccaguggaggcugcgaggaugucggugauuuacgcgccgagcuguagcugcaaaaggacaagggcaagugccggcccgaccuagggcccaccggucucuggcuugcucuugugaguaggugcacccugcccgcuugugguggccucagggguaagaaaucaggacccacccaggcuugguggcaugcauguuuagucccagcuacacagcagggaggcugaggcugaaggaauacuugagcccaggaauucaagacuagccugcacaacauagugagacccugacuuuaaaauaaauuuaaaaaaauuaaaagcaacaagacuuucugcuuguauaugaugauguuaguaugcugacuuacaagguuagaucauuuugauaugugugauguagguuuucaaagcuggcacuguuuuaugcuucaaauauuauuuuuauucauugguucucaugggauuucaucacuaagcuguaaaucaauaaucauaauguugaggggaggggauuacaaaauagcucuucaaaaucaucuuugcauuucucaauaaacagcauucccuuuuggacuacagugaaaaauauugagcuuuguuuacuuugaaaaugagucuuagucuaugaaugccuggguagggucaagaaugaaaaaugagaggaagagagaagcaucaggaagauaaaaugaucaaucucacaaa

SEQ ID NO: 1457 - RNA, 534 nt, Homo Sapiens
caagcuuuucauugguggccucaauagggaaaccaaugaaaagaugcuuaaagcaguauuugagaaacauggucccauaucagaaguucuuuugauaaaggaucgaaccagcaaauccagaggcuuugcauuuauuacuuuugagaacccugcagauguuaagaaugcugccaaagauaugaauggagagaaaucauccaagcucccaagaaaccagggauuaugcuccaccaucuagaggcuaugcauacugugauaauggucacucuagucgggaugaacauuccucuagaggauauagugauagugguggcuacgacgaaacccgugguagagaucauucugaucguacaaguggaaguucuuacaaaaaugaauuucagggauaugggaccucucauggugcaccaccugcaagagggccucggaugucuuaugguggaagcagccacccugauuauaacaauacacgagauacauagggcagaagucaagaaaguuacucaagaagcugcggugauuuuuacuuuugug

SEQ ID NO: 1458 - RNA, 4630 nt, Homo Sapiens
agggggcgggugugcugccacccauuggcucaggccgauaccacgcgccccgauacccggcacaggagccaccucccagagccccgcaguccaugccucagucggccugcgcuccucagccuggcgguucuaccuccgaggguucgcccgcccuugguuuuccuuacaccuuagccuuuggcuccuuugaccacucgaagccccacagcguguuccagcggacuucaccagcagacccagaaguggugggugaaacacugccucuguuccuccuugagccugucgggagcugcugccugccaccaccaugucugcugcaaauccugagacuccaaacucaaccaucuccagagaggccagcacccagucuucaucagcugcagcuagccaaggcuggguguuaccagaaggcaaaaucgugccaaacacuguuuuuguugguggaauugaugcuaggauggaugaaacugagauuggaagcugcuuugguagauacgguucagugaaagaagugaagauaaucacgaaucgaacugguguguccaaaggcuauggauuuguuucguuuguuaaugacguggauguccagaagauaguaggaucacagauacauuuccaugguaaaaagcugaagcugggcccugcaaucaggaaacaaaaguuaugugcucgucaugugcagccacguccuuugguaguuaauccuccuccuccaccacaguuucagaacgucuggcggaauccaaacacugaaaccuaccugcagccccaaaucacgccgaauccuguaacucagcacguucagucugcugcaaauccugagacuccaaacucaaccaucuccagagaggccagcacccagucuucaucagcugcagcuagccaaggcuggguguuaccagaaggcaaaaucgugccaaacacuguuuuuguugguggaauugaugcuaggauggaugaaacugagauuggaagcugcuuugguagauacgguucagugaaagaagugaagauaaucacgaaucgaacugguguguccaaaggcuauggauuuguuucguuuguuaaugacguggauguccagaagauaguaggaucacagauacauuuccaugguaaaaagcugaagcugggcccugcaaucaggaaacaaaaguuaugugcucgucaugugcagccacguccuuugguaguuaauccuccuccuccaccacaguuucagaacgucuggcggaauccaaacacugaaaccuaccugcagccccaaaucacgccgaauccuguaacucagcacguucagucugcugcaaauccugagacuccaaacucaaccaucuccagagaggccagcacccagucuucaucagcugcagcuagccaaggcuggguguuaccagaaggcaaaaucgugccaaacacuguuuuuguugguggaauugaugcuaggauggaugaaacugagauuggaagcugcuuugguagauacgguucagugaaagaagugaagauaaucacgaaucgaacugguguguccaaaggcuauggauuuguuucguuuguuaaugacguggauguccagaagauaguaggaucacagauacauuuccaugguaaaaagcugaagcugggcccugcaaucaggaaacaaaaguuaugugcucgucaugugcagccacguccuuugguaguuaauccuccuccuccaccacaguuucagaacgucuggcggaauccaaacacugaaaccuaccugcagccccaaaucacgccgaauccuguaacucagcacguucaggcuuacucugcuuauccacauucaccaggucaggucaucacuggaugucaguugcuuguauauaauuaucaggaauauccuacuuaucccgauucagcauuucaggucaccacuggauaucaguugccuguauauaauuaucagccauuuccugcuuauccaagaucaccauuucaggucacugcuggauaucaguugccuguauauaauuaucaggcauuuccugcuuauccaaauucaccauuucaagucgccacuggauaucaguucccuguauacaauuaucagccauuuccugcuuauccaaguucaccauuucaggucacugcuggauaucaguugccuguauauaauuaucaggcauuuccugcuuauccaaauucaccauuucaagucgccacuggauaucaguucccuguauacaauuaucaggcauuuccugcuuauccaaauucaccaguucaggucaccacuggauaucaguugccuguauacaauuaucagaaauuuccugcauuuccugcuuauccaaguucaccauuucaggucaccacuggauaucaguugccuguauauaauuaucagagaaaaaugauauuuuaacguuuuuaauauuuuuguuacauugggaaugauauuucuuucuaauuuuaaaaaaugguuuaccauauucuuuuuuuucugccaccuuucuuuucaggcauuuccugcuuauccaaauucagcaguucaggucaccacuggauaucaguuccauguauacaauuaccagaugccaccgcagugcccuguuggggagcaaaggagacauauccuacuuauccaaauucaccaggucaggucaccacugggugucaguugccuguauguaauuaucagaaaucuguggaccgaagcauacaaauggugguaucuugucuguuuaauccagagaagagacugauaaauuccguuguuacucaagaugacugcuucaaggguaaaagagugcaucgcuuuagaagaaguuuggcaguauuuaaaucuguuggauccucucagcuaucuaguuucaugggaaguugcugguuuugaauauuaagcuaaaaguuuuccacuauuacagaaauucugaauuuugguaaaucacacugaaacuuucuguauaacuuguauuauuagacucucuaguuuuaucuuaacacugaaacuguucuucauuagauguuuauuuagaaccugguucuguguuuaauauauaguuuaaaguaacaaauaaucgagacugaaagaauguuaagauuuaucugcaaggauuuuuaaaaaauugaaacuugcauuuuaaguguuuaaaagcaaauacugacuuucaaaaaaguuuuuaaaaccugauuugaaagcuaacaauuuugauagucugaacacaagcauuucacuucuccaagaaguaccugugaacaguacaauauuucaguauugagcuuugcauuuaugauuuaucuagaaauuuaccucaaaagcagaauuuuuaaaacugcauuuuuaaucaguggaacucaauguauaguuagcuuuauugaagucuuauccaaacccaguaaaacagauucuaagcaaacaguccaaucagugagucauaauguuuauucaaaguauuuuaucuuuuaucuagaauccacauauguauguccaauuugauugggauaguaguuaggauaacuaaaauucugggccuaauuuuuuaaagaauccaagacaaacuaaacuuuacuggguauauaaccuucucaaugaguuaccauucuuuuuuauaaaaaaaauuguuccuugaaaugcuaaacuuaauggcuguaugugaaauuugcaaaauacugguauuaaagaacgcugcagcuuuuuuaugucacucaaagguuaaucggaguaucugaaaggaauuguuuuuauaaaaacauugaaguauuaguuacuugcuauaaauagauuuuuauuuuuguuuuuuagccuguuauauuuccuucuguaaaauaaaauauguccagaagaggcauguuguuucuagauuagguaguguccucauuuuauauugugaccacacagcuagagcaccagagcccuuuugcuauacucacagucuuguuuucccagccucuuuuacuagucuuucaggagguuugcucuuagaacuggugauguaaagaauggaaguagcuguaugagcaguucaaaggccaagccguggaaugguagcaaugggauauaauaccuuucuaagggaaacauuuguaucaguaucauuugaucugccauggacauguguuuaaaguggcuuucuggcccuucuuucaauggcuucuucccuaaaacguggagacucuaaguuaaugucguuacuaugggccauauuacuaaugcccacuggggucuaugauuucucaaaauuuucauucggaauccgaaggauacagucuuuaaacuuuagaauucccaagaaggcuuuauuacaccucagaaauugaaagcaccaugacuuuguccauuaaaaaauuauccauaguuuuuuuagugcuuuuaacauuccgacauacaucauucugugauuaaaucuccagauuucuguaaaugauaccuacauucuaaagaguuaauucuaauuauuccgauaugaccuuaaggaaaaguaaaggaauaaauuuuugucuuuguugaaguauuuaauagaguaagguaaagaagauauuaagucccuuucaaaauggaaaauuaauucuaaacugagaaaaauguuccuacuaccuauugcugauacugucuuugcauaaaugaauaaaaauaaacuuuuuuucuucaaaugug

SEQ ID NO: 1459 - RNA, 3881 nt, Homo Sapiens
auguggaacuccacuccaaaagcggcggcuugcggcggagcucucucuagugaggcggccagcuggcguucguggcacacuugcugucggcuccgcucaucuguugggaaugcguccugugggccuaguccuccgcuggaagaaacgcgcuguucuccccaaccaccguuuaucauucuuauucaccgucuccggaauguccauucaguuuccgcuccugagagacuuagugacugaggccaggcaaagauuucaccuuggggagggggaacguuaaaccuuuccuccagcagcuuucguguuuuaaauuguauucauccgccauggaaagacaucagaagcccaggaucuaagagacagacugaaaugaagaaaguagauaauauugugagaauaaugaacaagcuggucacugaacagcagaaccguaauggagucccaguuaaaggguuuuaacuuuauuucgucacuuuuugcaagcaugauacaaagaaaacaaacaccuaacuacgcuacgguuuauaguuaaaaggaagguggaagauccugagucauuacagcaaucacaaaacaugauggauuucuucauuuaaaaacacaaaagaggucuuggcauaguuuucaagggcaaagcaugacaagacucuccagugcuuucuuucaucccccucugugugccuuuuucugccugacucacagccuggcucaauccuaaucuuucuacugcaaagaugcagcauuuaaagcaauuuuuccugugcaguauuuguagaaugacagauccugccagaagcucuuggaaacauuuuggaacuaucuugcuuuucuguauguuaugauccaucuagcaccguuuuccuccugugguagcaaaugacacuuuuuucaagcaucagcagcagaaaugagucuaccagauggaauaagauacugguaaagggaaagauuuguuucuaagacugcacaaaugaaugcacccaaaucugugaguugauuaaucugugaagaaauacaacuggcaguauuuacauaucucaaugagucucaaaguguggucgaggaagcccuggggguccuugggacccuuucagagguuccacgagcucaaaucuauuuucauaaccaugcuaagucuuuauuuccuuuuccacuccagaggcuauauaaugucugaugacaucaucgcuuuauaggaugagagaauacgugcuuguauauucuuguguuuguaagacuuuccagguuuaauuuauuaccauauggcaauuuucaauaaguauaacccacaaaacccaacagauuuuuggggcaccucuaacaaggguccuaagaccaaaauguuugaggacugcuaaucgauauuauucaauugucuaguccccuaaacuccaacccuucuuaucaggacuacagagagaaaacagguggucuucuugacaaucgcuuuguauuuacauucagugcuuuaguagaagagaagaaagaaagagaaagcaagccagagaggccucggaaagagaagccuacuuauuaaaaauagcuuucuggcuggucacgguggcucacuccuguaaucccagcacuuugggaggccgagacgggcggaucacuugaggucaggagucucagaccagccaggccaacauggcgaaaacacgucucuacuaaaaaugcaaaaauuagccgggcauaguggcaugcacgccuguagucccagcuacuugggaggcagaggcaggagagccacuugaacccaggaggcggagguugcagugagcggagagcgagacucgcgaguacucgucucaaaaaacaaaacaacaauaacaaaaacagcuuuccaucccuucccugaggcuuggguaccugaaccacguuaaucuguaaaucacugcuucuguaacuuuuccuugguauaaaucacauaggcaaugagguuggguauaaacaguaauuguccuugaauuggguagauguuuucuuauuauuuuugucuaagaggucauugcgauaggcagaauucuaagaaugauccccagugacgcuugcccuuguauaacccccacccauuugagugugaggugaaaccuaugaauuugaugaggcaauacuccuguuauuauguuacguuuuaugacagaugugagauuuuccaggugggcccaaucuaaucacaacagcccuuuaaaagcagagauuuuccgucugcuaagagcagaagaggaagucagagagauuugaaggaugagaagaauuugacgugcugcuguuggagggggcuacauaccaagaaaugugggcauccuauagcaacugaaacuggcuccuggcugacagccagcagagaaucaggauaucagucccagaaucauaaggaacugaauucugcuaaaaaccuaaaugagcuuggaagugggauucuuccgagaagagcccagccgggucaccaucuuaauuuuggucugcgaaaccguaagcagagaauccacucaagcccaccuggaucuacagaacugugagcuaagcugaugugguaauauuuuaaagccgcuaaauuuuuguucauuuguugugcagcaauaggaaucuaacacaaagguaaauagaauauauuuuuuaaaucgaggcaauauucacauaacauaaaauuaaccauuaauuaaguguacaacccaguggcauuacuacauucauaauauugugaaaccaucacuucugucuaauuccaagacauuuucaccacccuacaggaaacugauacccauuaagcagucacucccuguucccuccuccccuuagucccuggcaaacacuaauaugcuuucugccuauggauuugucuauucuggagguuacauacaauuugugaccuuuugugucuagcuucuuucacuuaguuuaauguuuuaaagauucauccacauuguagcauguaucaguacuucguuccuuuuuauggcuaaguaauauguguauauacaacauuuuguuuauccaucaauugauaacauuuggauuauuuuuacuuuugucuauugugaauagugcugcuaugaacauuuguaugcaaguguguauuugaauauuuauuuuuauuucuuugggguauauaccuaggaguagaauuguugugucauuugguaauucuguguuuaucuaagaaacugccaaacuguuuuccacaggcugcaugauuucacauucucauaaguaauguacaaagguuccaauuuguccacauccuugccaacacuuauuuuccuuuuuauaguagccauccuggugggugugaagugguaucucauugugguuuugauguacuucucuaaugacugauguugagcaucuucucauguauuuguuggccaaucauauaacuucuuuggagaaaugccuauucaaguccuuugccccucuuugauucaguuguuugucuuuuuguuguugaguuagaagaguucuuuauaaauucuagguacuagaccuuugucagauaugauuugcaaauauauuuucuuccauucaguagggguaaauagaauauugagagacuuuuuauauaguaauauaaaaaagcaugaagggauguguuuugcaaaaaguaagauuacacaguauuauacaacuauguuauacacuuuggcucuugguuuucucucuaaggaauaacucaugaagaacauuccauguguuaagguauaccucuaauucuuucuaaugccuacauaauauccuauugcaugggugugcuauucacccccuacuuaugguuauucauucuguuucuaguuuuuggccacugccaacaaugcugcaguuaacauccuuguacaauauauguuuauguauuuuaaauuucaguuuaaaaggauuuauucuga

SEQ ID NO: 1460 - RNA, 662 nt, Homo Sapiens
aauugaaauuuuaccaaaaggaaggaaguggacagaaauggauuugcaccauucuguccaaccagaguccuugcuccuaagcacagcaucauuuuccuucucguuaauuaucccuuuuaacagcaacgaaaugaccuggccggcacacgagaacacagagaugaggccacaccuuguaauuucugggguucugagggggacccugguggugguucugggugcugcgguucuuucaguaaagaacuuccaggaguuucuaaucagcugcuuucaucaagauucucauaaccuucuccugcugccgcuuucaaguggguuuguucccgagcacauuauuaggaaagcggcuauaauaacugcuuaccugccuccggcuccgcuccacaaacacccgccaagcccacacugugcaaaacaguaguaacacgcccgccugagaauggcuccgcggcuccgcauugcugccuaagagcuuuccugcaugugaucucauuucauccucaccgcaacuccgggccggggaacucauguccccggugaggaaguccaggcuugagaucggccucaacagucggagguggcaaagccagggcuugcucgaagccccaccuucucacuguuggggagcaggcugacuccaagcuguggaauccugugcaggg

SEQ ID NO: 1461 - RNA, 536 nt, Homo Sapiens
auguuuuucgcuuuucacaagacggcaccgaaagcgaaggaagcuccugcuccuccuaaagccgaagccaaagugaagguuuuaaaggccaagaaggcaguguugaaagguguccgcagccacacgcaaaaaagaagauccgcaugucacccaccuucaggcggcccaagacacugcgacuccggaggcagcccagauauccucggaagagcacccccaggagaaacaagcuuggccacuaugcuaucaucaaguuuccgcugaccacugagucggccggaagaagauagaagaaaacaacacgcuuguguucacuguggauguuaaagccaacaagcaccagaucagacaggcugugaagaagcucuaugacagugauguggccaaggucaccacccugauuuguccugauaaagagaacaaggcauauguucgacuugcuccugauuaugaugcuuucgauguuguaacaaaauugggaucaucuaaacugaguccagcuggcuaacucuaaauauauguguauuuuuucagca

SEQ ID NO: 1462 - RNA, 2189 nt, Homo Sapiens
gccacgacaucaacggugcccuggagcccuccaacauagacaccagcauccuggaggaguacaucagcaaggaggaugccuccgaccugugaguggcccccucgcccggccugcacccgcccagccccagcccuucgccucccuucugucaccagggaggucugagggccggaccuggggucugcuguggucccaccucugaaagcugcuccucgucccuucccagccacugacuccuccgaaaucuccauaguucccugcagggagggggcggcuacuucccugcuggggcugggguccuggcuggagcugagccgccccccuuccccgcagcugcuucccugacaucucugcuccagccagcucggccuccuacucccacgggcagccugcgaugccuggcuccagcgggguccaccaccugagccccccuggggguggacccuccccggggcgccaugguccccucccacccccgggcuacggcaccccgcugaacugcaacaacaacaacggcaugggcgcugcccccaagcccuucccggggggcaccgggccccccaucaaggcugagcccaaggcucccuaugccccagggugaguaagggcagggaguagggggauacagcggcauaggggcaggcagggagcagggcuguggccgugaccugggaggugcuagacacuggccuggcaugggaugggcugggugacuggcugugcgugggcaggugagggaagggaggaugaguccaggucaaggggggacuccugggcuuuguucugaggcagugggcagccacaaagcuucuaagcaugggagugaugagggcugacguaagugcuagaaaaaucucgaugcuguguggagaguggacaggaagcggcgggacuggaggcugugacuguuuaccuucaugggaacaccugcauacccgugcacgcgcgccaagcccacccacuuacgcauccagcugacguguacuguggccacaggagcuggcccauggcucagauguggcaccucaguuccccccuacccaagcaagccucauggggcccagaacccaggcccuuccccccaucuuucugaggaguccacaccaagggccugacccagggcugaaccuuaggccuggcuuugaccaaagguuccaggcagccacccggccagccagacuccagggcagcucccggggcacaugcucacagcgggaggcugggagcaugggucugcaggggagcucagggcaaauguaggggccccugucucuggguggaagagcauuaaaacacuaggugcaugaacucuguguucagacagccuggcuccaacuucagcuuccccauuuaucagccgucugccucgguaacccauggccucaguuucuucugugaagugagcccucaaaugcuuaccccucaagauuaucgugggaagcaacaagggcacagaggaugcccugggugcaugguggccauggacacauggccggccgugcuuccugagcucccuggcuuuuggggagaagggaguggaggccaggcuuggggugccaggggugaaccuuugcugcagaaggcaaacuguuugcuugaggcugugaggcuguuccuaaacuacaggccccugggggcagagggaggagaacuaacauuugguaagcgccugcuggugcccacugcuguaucaugugccuaugauugcgugagcucaucagccuuccuggguauccagcuccugggagaccccacaaggagcccuggccacugcuaccgucaggauuuuaauggcacacugaggcucagagagggaaaggggcuuguccagagccacacagggacucugugggcagggccacuccaggaagggacccagggccagaccugagucuaggugauaaacaagacagacaugaggcugggugugguggcacacaccuguaaucccagcacuuuggaaggccaagguaggcauauugcuugagcccaggaguucaagaccagucugcaacaugaugaaaccccaucucuacaaaaaauacaaaaauuagcugggugugguggcgugugccuauagucccagcuacucgagaggcugaggugagagaauaguuugagccagggaggucgaggcuacagugagcugugaucaugccacugcuagggacagaguaagacccugucuc

SEQ ID NO: 1463 - RNA, 2790 nt, Homo Sapiens
cuuuuugggaaagugggggcugcuaccucacuacuuugauguguaccuuuuguucaagaacuuucuaaaacuuggagcuaaucauggguuauuucagaagauguaagcauuuuaaguuuuuuauugaauuccauccuuauuuaaaaggccugguuauguaauauuuucuguuuuuuuuuuuuuuuuuuguaugguuucccacauugauuagguuguuuucuucauuuucuuaauagauuaaaaauacuuucuucucuuucuauuugugucuucuuccauuuaguauuuaugggagggagcaagaagggaaaggaugucuauuuuuaaaauugacuacaaucaugacuguucuucuugucauucuguagcagcuggauuuauuaccaucucuuauuuaaagguccuucagaacacguugaagcaguucauuucaggucaauggcugguaagcaaugucaggaccucuggggaaggagaagcugacgggaucccagaggaaagaauugagguuguuugcucccuuguagaaagcccacagaucccuucccagacuagaaaaaaagugccagaguguccugaaacuuuccuucuaaggcacauacuucaaagagacuggggauuccuuuguuuuaaauauagguggggucucacaguguugcccaggcugggcucaagcgauccugccaccugggccucccaaagugaugggauuacaggcaugagccaccaugcacggccauggagauucuaauguggugccagcugccagguaagaaagcugugagacaauguguugauuuuccuuuacuacgucagguuugaggacaucaucuagcaucaacggguaacgucacccuuuguuccaucuuugggaaauaauaguaguagcuuguuacuguuagcugaccccuacauuagcaucaauaaaguaaaucccuuuaacuuuccuuuuggccuuuccuuucucucucucugccuccccaccagccccgacucucuccugugugcguacacauccacacacaccuccaugguauuccuucuuucucccaccuaagggaagcugugcccgaucuugcugcaguccaggucaccguacugagaugagucagccacagacucuaaacacuagcagcgauuagccguauguagccaccaagugcacuguuuuagacagguuuacacagcucuuugcuguccacucauaucagcuguguaguagcccaaggcagccugucaggcagaagaauuaccaaccaaaguggaucuauucauaagauaaaagauccggaguccgugcccucuuaaaaaacuuuugucuucagacauaugggugcguguucaucucuggccaaaacuuuguuuccaguuucaaagggcugguugcgaagguggccuuguaaccuuucuguugccggcucuguuaguugccugauaagcaguagcuaauucauccuccucagaauuugagaguggcaucuauuagauucagaccaccaaggugccugcgcgggcucuccugguuacgacugaguccccuuuucucaucuguggggugaacgcuucuauuugcagaaauuugcuugcaucuuuuuccuuuuauuuauuauuacuuuuuagagaugcggccuugcucuguugcccaggcuggagugcgguggacucuuuucuuuuguugaucuuugccauccucugccuggcuuaaugagguucuuucccugcguauuuaugucccaggagcucaccuucccccuagguuuuuaagaaggaagcagaaaauguuacaaaguauaagggauucuaugaaguccauagauaggauuugcuuugggaguagaugauuucuucuuauuuugguguaaacaucaauuuggauggcaauuagaaugucuuuagccucuuuaaaaagcccuucuggggcaaaccuuugcaagucacucagcuggcauguaaugagauuuuuauuugcauggcuuuuuuuuucuaagucucucuagaagaacauaaggacauucugaacaugcaaggaauacaguuauucucacaucaaggaucaauuuuauuuuguaucuucauuuuaugucauuuuccuuuauuuuauucacauuaaucuagcauuaauuccccccagagggaaugauauuuuugguugcugccaccuguguuauuaagugacagcuuuucuuuaucugcuuuucugaauuucauauuuauauacuuuauuguaguuuuuuaaaaucuauucuagcugggcuagaaucuuccaaguauuaauucauaaugaacuucccucuucuggaauuguuuaggagggcuaauguuccauguucccuucguugcuauagauaugaaguuauuucgauguucuuugagugcuuuauuauagcgauaacugguacugccuuugauuaaaggugagcuauauggaguuaagcauuuuuauacuaguaacuauuuauugagaauuuucagaauucuauagcuacuugucuuuaacaguuauaagaggcauguauuuuuuuuuccuucauggucuggaaguuaguuuucucuuuguuuggguagaucggaaugaguuguugagcuguguugaaaacacacaugaaucaaaaaagcagauguauuguagaaaugugauguuuucauguuucgggaauuugaccggaaagcuuuauguauggguuuuauuuuuaacaaagcaguaagggcuuacuuuuuaccaacuuguguguguguaaagauguauuuguucaagcuuuaagaauaaaccugucaauguacaaaugccug

SEQ ID NO: 1464 - RNA, 824 nt, Homo Sapiens
augaagagugacuuuuaucugcgcuacuacguggggcacaagggcaaguucagccacgaguuucuggaguuugaguucugaccggacgggaaauuaagauaagccaacacagcaauuacaagaaugaugucaugaucagaaaagaggcuuauguacauaaaaguaugauggaggaacugaagaguauaauugaugacagugaaauuaccaaagaggaugaugcguuauggccuccucccaaccgagagggccggcaggagcuugaaaucauuauuggagaugaacacauuucuuuuacaacaucaaaaauugguucccuuauugaugucagucaauccaaggauccagaaggcuuaugaguauuuuauuauccuguccaggacccugaaguguuuggucuucagucuuacuggauuacacuucaagauuaaaccaaucuaaacugaauauugauguggacaugggggggugggaguaguuuuuaauuaccauuaucaagaacauuuugugucagggcaguauauuuuuauaaacuauaaaugauuaucuuuaauaaauaugugauaaaauuuaaaaaaagcaaaacaaaacuucuagagaauaccuucaaaaccuuggugagggaaauucuuaaacagcacaaaaaucauuaggaaaagaucaacuuuaacauugucaaauuaaucaaugacuucucuuccucaaaagacaucaaaugggacaagguauuuguaacacauauaaacaaggauuuauauuuagcauauauauaaauaauuucuauaaaucaauguuauauuucaauaaaacaacugagaugagaa

SEQ ID NO: 1465 - RNA, 4026 nt, Homo Sapiens
guuuuuguuuuuguuugagacagaguuucacucuuguugcccaggcuagagugcagugguacaaucucggcuuacugcgaccucugguuccugggcucaagcaguucuccugccucagccucccgaguagcugggauuacgggcgcccgccaccgcgccuggcuaauuuuuguauuuuuaguagagacgguguuucagcauguuggccaggcuggucucgaacuccuggccauaggugaucugccugccucguccucccaaaguacugggauuacaggcgugagccacugcacccacccacgccuggcugauguuuuuauuuuacucauccugacugaggucugacaauccuagaagcugaaguucccgggcauccuuuuguuucuucugacuccccuuagugauagauuuucuugugauuugggauuggaugcucauggccagcugggggcucugugggaauccgggguggccuacuuugcaggcaguccuuccagaugguucagccuuggcuuucgcuagcuacccaggagcgccagccccagcccauuuugugugugguucucagcuugcagguggccaccaaagccaaccccccccacugccccgauugugggucccuauguuugagguucccggugauguuucggggggcuucucccuucuuacaagcucggucaugcauauauuugaucuggcguugccaggcauucuguaagggagggcuuuuccaguuccuggaaauggaacuggaaaauguggcuggaaacauuaauauggcuggaaauggaauuugccugcagccacuacuuuugaacccaucuuccgggcaaucccuucugucuugccggugguuggaaacuugcagguggaagucuuccccacccaguucugcagcccuuggcugccgagcaggaaugccugagaugucuggcuaauuccucggaaugucccaguucaggccaaccucccucccccuucucccaccaggccuucuugggcagcagggaggcagcucuggagggagccgcugccucagcaguuucgccccagccacccccacugccugggccuucauguaaggaggcuggguggugaggcccuguggugaggagcagggguuuugcauucacggaggaccuggguucaaauaccaggaccguugcuuaauucugggugacuucaggcuuuuuuuuuuuuuuuuuugagauggggucucgcucugucgcccaggcuggagugcagugacaugaucuccgcucacugcagccuccgccuccuggguucaagcaauucuaccucagucuccugaguagcugggaugacaggcacgccccaccacgguccagcuaauuuguuuuuuggguuucugagacggaguuucaugcugcugcccaggcuggagugcaguggugcaaucuuggcucacugcagccucugccuccuggguuccaagcgauucuccugccucagccucccgaguagcugggacuacacccagcuaauuuuuuaauagagacggaguuucaccauguugaccaggcuggucuugaacugaccucaggugaucugcccaccucggccucccaaagugcugggauuacaggcgugagccacugugccucgccuaauuuuuguauuuucguuagagacagggauucaccauguuggccuggcuggucucaaacucccgaccucaagugauccucccaccucacccucccaaagugcugggauuauaggcaugagccacugggccccgccaggcuuuuuugagacaguaucgcucugucgcccagguuugagugcaauggcacaaucucagcucacugcaaccuccaccucucagguucaagcaauucuccugccucagccucccgaguagcugggauuacaggcgcccaccaccaugcccagcuaauuuuuguauuuuuaauagagauggauuucaccauguuggucaagcuggucucaaacuccugaccucagguaauccacccgccucagccucccgaggcaugagccaccacgccaagcccaggcuuuucuuuccaucggaaaauuaucaucucaauaagcacuucaguaagaaaaaccacaacauaaucaucgaagcaaucccucacggauggaguugaggccacuuccagacuuuccuaauaugaagaaggcaucagaugucccugugcuggcuguuucacuugccugugugggaggaaccccgcaaacagggcuccuggggcagaggguguaauuuacaauuccccaguagcagcugcucauccaaagagcugcuagcaauuuacacccccaccaacagcacagggugcaccugggucacacggguugugugugaggguuuucugauuuuccccaaucuugugggugcuuagagucaagcaccccuucggacaaucacaagcuguuugcuuguuuuugcauucgaagcuacgggcacugccuuacacucuaagugcccaucucuuuccucaccaagccgaguaggagggguucugaggagcuccccuguaccggugaggggacugggcucacacggggcuggguauggaagccucgagagcccuuaucugucugcaucgugcuagacguuaccaugaccuggacagccuccaucgccccgggggcucugacaugcucagaucccaggauggggcugcaguuauaggggucucagguuggccuucccgagacaggcgucccuguccccuuguguccccacccuuggcuguccccaggccucucccuuuuccuguuuugaugcuggcucagccaggcccggagacaggggcaugauguccuaauccuccaggcgggagccaccauggaggguucccguggacucaguccccugccaagccaccuuucccagcacucacauaugcuccaccuggcacaugauacacgugggggcuccugagccccagcacccugacuuaguggggagggaccccaccggggucccaugaagcccccugacuuccacuccaggcagcaggucgggggaacaccaguugccugcccuggccgccagcacagcacucguaaaucagggggugucuggggcgucggaaauggcuguguggaaugucggggugggguaggcugggggugagcccuuaacucuuagaagggugggguguggggcagaaggagcagaugccuggauucgagggugcaggagaugggcuggugcagacguggggccuccuggcugcaggggccggcagugaagagguuagcucccagcccaggcagggcauaaauuuggggcacagcucccacucucaggaccugcccgucacaauggccguagggaaguuccugcugggcucccugcugcuccugucccugcagcugggacagggcuggggccccgaugcccgugggguucccguggccgauggagaguucucgucugaacagguggcaaaggcuggagggaccuggcuggguaaggacuuccagggacccucugugacuucccaacuuuccccagcccugacccugcucacugucagcgcccuucccucccacaggcacccaccgcccccuugcccgccugcgccgagcccugucugguccaugccagcuguggagccugacccuguccguggcagagcuaggccugggcuacgccucagaggagaaggucaucuuccgcuacugcgccggcagcugcccccguggugcccgcacccagcauggccuggcgcuggcccggcugcagggccagggccgagcccacggcgggcccugcugccggcccacucgcuacaccgacguggccuuccucgaugaccgccaccgcuggcagcggcugccccagcucucggcggcugccugcggcugugguggcugagggugcccggccuggcacccagaagcugcagugcugggggagcucggcugacuuauuuauuggagaccuggaugcagagacaacgaggaggggagugggcuggggcgaccagcagugagugcaauaaaggacaccacucucccggc

SEQ ID NO: 1466 - RNA, 1260 nt, Homo Sapiens
aggugccgcccacagccccucgcugcccuggguccagcugaugcucagcuccaugguccggccgcugcugguggcgguguuggcccaagggugaugcucuccucccucugccgggaacaccccuggcaaggacgcugcccacccauccccgcacauggaaaggaggugaggcagcugcggcaucuucacagaacacguccccccgacacgcaccaagacauggcucgaggcccgggccucccacacacccaugggcuuccagcacguccuucccacgucagacaccagacagagccggugcagguggcuuccagguggcaugucccuucggaugggcucugccgucccugucaugugcaccagcugcugcauccacccuuagugccagcucugggggccuaagcaggagcucagggacauggagaccguggagaggaggcauucacuguggggugucccaaggcugggcaccaaggcaggaccuccgugugccccgaaugccggcuucccuggagacugcagccagcggggaucucucacaucagccucccaagaccaccgugaggggggcgcuuaggagcagaaacacccaggccgagcaggaugagcaggugaagcugcccaacgcaggggacgggacgcagaggcgauucacgagccuggggcuccagcagcagccaggcggaucccgccacaccuuucgcucucagcuaccagucugccugccaccaucaccuucccgcgugugaguggggcccugguuccccaagcagccgcugacucccggacgccugcuggccaggccccggucaugagugcauccggggaaggcuucgggccuacaggaacggaaggaaaagccauccagccucccugacccuccacacggaagcugagggguuccccauacaccggcugccggggacugccucgacucugguuuuggcagagacaggcccugcuguguccgucaucucugauggaagugacagccauuuccccugcagacaggccagagcggccuauccacgcuccacggugugaggccagugguggcguccccagggccacagcccagcgagggugaggugggggagcguccuggcugagggcugggccgccucccgcgugcucuggggaacaaugcuuccgcaccacccccgccccuuccuggcuucugugaaacugaacaucuccaaguaaauauuuucacugcuaagcacaggcagcacuucgaggcuucgugacgaagacguggaa

SEQ ID NO: 1467 - RNA, 4215 nt, Homo Sapiens
caucuuuuccuaaccuugucaggcccuggagcucccuuuguccaugccagugaccaucgguccucagaaugugcaguggaaguugcuguggacagugcucccuggucucugaggcccucuucguccuggucuggccaaggacuucccagaaaacugugcuuagcuguggcgggaggcacggccggucacgcagccuuccucccgcccuggagugggcaggccugcuuguguugugcagcggcagaacccuuccugacuuccagguuuuuccuggggugcggcaucccaucgcagcauuuucucugguuacccucacgaguuuccuccugcguuugguucuugaucuccagggccaucucccacgucuuccuuggaaaggggcauugucauccuuuuuguauuuugaugauuuugaaagauuucccauaguaacuguuaggaaguuggccucagaagcaaaaauucuucuuuugucuuggccccugugaacaaguguucugcucucagaugaagcagggaggcugcacuggagcuugguggccagcaggagggaaucaccaggguggugaagccugcgagauuucuccccgggugucucugauggggccacaugguggauuucauaauccaccgauucguuuuuuuaagccuuuauuguuaacaucaacugugugccaugcucagagaccugaagugaaaaggugaggaaggcgugcucacauuccagcacucaccacccggcaccgggacagcugacucagcacgugccguuuagguugcuguaaacagccggugagauucuccccucuggugggcagugcgugucugacaaaggcagucgggcggagaacaguuccuccgcugugguccuuugccacuguaccaggcccccaagagcuggggggagccccagggagccucagccuguugagugggggcagcugguuuguccuccgagguggaagaggugauuucugaggaggucaugcuccgcuuggcucguucacagcauuucagagaguccgaaagaggagaaagaccuuggcaaggggugugucaggggugggcccagggacgcugguggccucauguggacugacuuucaugaacagaaacucagaaacaguugcuucuggauuuuggcuucucagauaaacauucuuuuuguaguucguuuguucaucccucauuuugcugucugacuuugccuuucuuuucccuucacuauuacugaugaccaaggaaacuggaaguuaauuccagaggcagugggguugcuccuguugucugugcagacuggaguuccucugccucugucagcaucuccucuguccuuccccagccuuggcaggagaccaguaaugaccucuguccccgugcaccccagugauggccgccguccccgugcaccccagugauggccgccguccccgugcacaccagugagggccgccguccccgugcacaccagugagggccgccguccccgugcaccccagugagggccgccguccccgugcaccccagugauggccgccguccccgugcaccccagugauggccgccguccccgugcaccccagugauggccgccguccccgugcaccccagugauggccgccguccccgugcaccccagugauggccgccguccccgugcaccccagugauggccgccguccccgugcaccccagugauggccgccguccccgugcaccccagugauggccgccguccccgugcaccccagugauggccgccguccccgugcacaccagugauggccgccgugcccgugcaccccagugauggccgccguccccgugcacaccagugauggccucugucccccaugcacucccagacaggcaaugucccugugggccugucccaggcucuguucucagcaggcugggcucagcccuggugcagggagugaggaggugggaguaguagggaccagaaaaaguggcagcuguugacaacucugccaucucuuucugaauguaaugggagguccugucuuuucagcuugcaaggaaggaggguccgaggcaacuccgcuguugcacauuuagggaccccugaacuuaaaugacagaaugcccugaccacucuggaaggcacuguguucauguuugugugcuugacucuugauccguaaaauggcuguuugugcaggucauuaacugugagauucagagaguaggugcacacgucccugcagagauuccagcaggacugaaaaccaguagaaauauaucagcaccuggaucuugccuccugagucaguaaggauaugccacagucacgaaggcagugggauuucgagggagggaagggaaggcggcaggcggggcaugcccuccggggugcccgaacacaccugcugcauccacaugucuucagagcccucucccugugggaggccuuuuucaggacagccuuggugaacuggaaacggaaucccagcccuugguggcccugcagugacuuggaccuuuccgaggucacccugccacugcgugcccuucagucccuccuggcaggugggggcacaucccccagccacucccauuuccugacauugucacuuuguauaacuggaagccuucugugaaauuuuaguuuucaaagcauuaucuggugaugggcaacccagggcagcgaaucauucagaauuuucuuaucuaggcuaauaaacauaauaaaaucaauaaggacuuugaaaguaacuccacuggguucaggaaacugaguguggccgcccuguggggugguguuuggugagugcuucccggaggugaguaguuaauucacaggagugacuaauggcagcgucccacucacuccuccuuccggggucauggucucaaggggucacuccaugcacuggggaugucagcucauuacagaaugauauauucgggaagugucucaguucugagugccuuugagggaauuugcacuuccguucccacacagccuugcauuguguguguuagaggcugugggccuugggcaggaggggugaguguuggcacauaccucccgucucucccagccuucucugacucugacuuucccucuugaaggcuaccggcucucugaccaguuccacgacauccucauucgaaaguuugacaggcagggacgggggcagauugccuucgacgacuucauccagggcugcaucguccugcaggugacggaauggcuucacguggguuuguggugguggugggaggggcuugcuugccagcgugaugcaccugaccuucaaucuaaggagcugggcauguguagaauuaguuuuuggagcuuauaaaagugagucucaucuuuggagaaguagccgguuagugaaguguggacaaacauguuuuccuccccuuggaaauggcacagagcagcccaucugcaagacgugguuuuucaguauccgguggguuauuuacauguauguucugguguugugguuuuuuuuguuuuuuguuuuguuuuguuuuguuuugagaccgagucucgcucugucacccagacgggagugcaguggcacgaucccggcucacucccaccucugcgucccggguuuaagcaauucuccugccucagccuccccaguagcugggauuacaggugacacccagcuaauuuuuguauuuuuaguagagacgggauuuugccauguuggccaggcugaucucaaacuccugaccucaaguaauccgcccaccuuagccucccaaagugcuaggauuacagacaugagccaccaugccuggccaacuaugguguauuuuuacaaaaacuuuuauucugagaaaaugggcacguuuucuguuguggucaucacuguguccugccgucugugugugaggucagcuguggagccuguggucgcucaggccgcccucaguggggucuccgagcucuucccgugcacuccagugucugcaggagcugguaaugcacccugaccugcaaggcaagcuccuugguggugucucuccugcugggcucucuuugagacccacgggagauggagagcagggcucaggggacccgccugggagcuccacacagaccucugcugcuguuugcagguggugauccaggucucuacccagguuccucaagguccugucuuguuggccuuggaauucagugagagauaggaacagcaugggguuuuuagaaauaauguggaaauu

SEQ ID NO: 1468 - RNA, 536 nt, Homo Sapiens; identical to SEQ ID NO: 1461

SEQ ID NO: 1469 - RNA, 597 nt, Homo Sapiens
auggagaccggcaggcaaacaggcgugucugcugagaugcucgccaugccccgaggucugaagggcagcaagaaggauggaaucccugaggaccuagacgggaacuuggaagcacccagggaucaggaaggugagcucaggagugaggaugucauggaccucacagaaggugacagugaggccucagccucagcuccuccugcagccaaaagacggaaaacacauacgaaaggcaagaaggagagcaagcccaccguggaugcggaggaggcucagaggaugacaacccugcugucugccaugucugaggagcagcugucccgcuacgaagugugucgccggucagcguucccgagagcacgcguugcgggucugaugcgggcuaucacuggcaguucggugucggagaacgcggccauugccauggcuggaauagccaagcucuuuguuggagaggugguggaagaggcccuggacgugugugagauguggggagagacgcccccgcugcagcccaagcauuuaagggaggccguucgcagguuaaagcccaagggccucuuccccaacagcaacugcaaaagaaucauguucuag

SEQ ID NO: 1470 - RNA, 2165 nt, Homo Sapiens
uauuacaggugugagccaacauguucggccuguuaagcacagagacacacaccugguauuacaggggugcgccaacaugcucggccuguuacacacacacacacacacaccugguacuacagguguaagccaacaugcuuggccuguuacacacacacacacacacacaccugguauuacaggugugagccaacaugcucggccuguuacacacacacaccugguacuacaggugugagucaacaugcucggccuguuacacacacacacacacaccugguacuacaggugugagccaacaugcucggccuguuacacacacacacacaccugguacuacaggugugcgccaacaugcucggccuguuacacacacacacacacaccugguauuacaggugugagccaacaugcucagccuguuacacacacacaaacauauauauuuuuaagacagaguuucacucuuauugcccaggcuggagugcaaugcgugaucucgucucacugcagccugcaaccucugccuccugccucagccucccgaguaauuggaauuauuacaggcaugcaccacuacagccggcuaauuuuuuauuuuuaguagagaugggguuucgccauguuggucaggcuggucucagaaauccugaccucaggugauccacccguuguggccucccaaaaugcugggauuacagucaugagccacugcuccuggucacguaauuuuuaaauauaauuuuagcuguaucuuguguucaguuuucuaggcuaccuuuuucacucaacauuacaucaggaucauuuuuccucauguuauucuuugagauauuuuuaaugggcuuguagugucccaucaugugauuuaccaguuuacuuucuguuuuuuaguuguuuacagcucuuccuucguugugaugcugugaaccucuugugcauaaauuaucaugugcaucucuaauuauuucuuagaguacagucccaggaguugugaaugugggugaagccccugcuccugcugccaggcccaccucucagagaguuucguguacacgugugcagggaagggcugaccuagcuaggucucugaaacccgugccagauacuaaaucugcacaggcugcgacagugagcagacugagggcgaucugugccuuauugucuuccuguuggaagagaacacauaaaucacguaucucaaaugugaggcaaauagcuaaugguguuuguguauacgaggaagguggagucaccgguucuucguggccaucagaggaccgacacgcccauaggucucaugcauuaagucugcguugagcaaucccuaacacgguuuuugccuacagauacauuugcacaacugugaaaaccagguacguauucauugcaucauuuuuuguaaaaagcugagagaagugcccagcaacacgucgugccgcgcgugugcauggaacaccauauagccucaccauuaauaggcaagaugagcgagacccauuaucagaugagaaaagcacggcacggaauacuguguccaaugugcucaccgucucaauuuuaaaccuaaaggagggagaacauuuucucaugcgugcauuucaucucugggagcacuuaagacgcugaagcguugguugccagugggaaugggaacuggguaucugugauacagggaugagaauuuucacacuguaccuuuaaauaccagaacgucaugaacacaucugaaaaacaauauucaaauuucccugaucaucuuucuuuuuuguuaacaauuauuuaaauucuggcacaagcaagccacuuuucaucaugcauuuggucuauagauguucuaccucccucaauuucgucuuguaauuuaaugaauaggggaacuggggccgggcacgguggcucacgccuguaaucccagcacuuugggaggcugaggcggguggaucacgaggucaggagaucgagaucauccuggcuaacauggugaaaccccgucucuacuaaaaauacaaaaaauuagccgggcgugguggcgggagccuguaguccaagcuaugcgggaggcugaggcaggagaauggcgugaacccgggaggcggauguugcaguaagccgagauugcaccacugcacuccagccugggugacagagcaagacuccgucuc

SEQ ID NO: 1471 - RNA, 4419 nt, Homo Sapiens
caaauguucuuacgguagccuggcaacaugucuuucucagccuggucuguacaguguggaggaaguaagggacuuuauuaagagugucacaauagcuauaaccugccagucaggugaucuguuuuuccuuggccaucucuccgucugcucaccacucuuuuuucccuaguacacgaauaucuuuaacauucaaaaauauaucuuaacacuuaggauagaucaaaauugguguucauucagauaacauugucagauucucuuagauccaaauauuucuuuuaacaacuuaacaguauguuaaaaccucauucacuugcuuggagagcuguuguacaguucuuuaaagaguucuuuauaugagguugaaucuucccuuucuuaauagucaaauucuauauauggugucuuccuuuggaacaccuuaccaugggcuauuuggucagcuccauugacuccuugccuugggaauuuuagugcagugagaguugugcucacuucuccuucacuucagggccugaugugucaggaaauggaguuuucugaauuaacaugaaaguugaguugcagauugcuugguuaaaaaacaacagguggggcacagagucucauaccuaugauugcagcacuucgggaggugggaggauugcuugaggucaggaguuugagaccgaccuggccaacauagugagacccccaucucuauuauuuugaaaaacaacagcaaauuuuuucuuaacauccaagacaaggccaccagucaaaacuaucaaguuuuaguaguauuuuccugcuugauuauauaauagccuggcuuagagauacaaccuuuaaauaaggaaucuuaagaugaugugcagcuguucuuugccuuauuuguuuguuuguugguuaguuuguaguuucuaagaaucugcucuguucagcuguacaguuccuucuucuggaguuaaccuguggcaaggauuauguuucaccugucacaaaaaugagaucugugccuuccucuauuauaaaguuagggcaugugauucauucuucgaaauacuucaaaauguacuuugguauguuuuugucuugaaaagagguuuucuagcuagaaauucggggcccagaaggucaaggcuccagagauccccuucucaucauccuucaguugucugaggagacagaggaucacaugugucacagugagugcugauuccccagaaucugcagucuuaagcuccccugcugacgcacacagccaguucucugcuucauauucaugugacccacugugaagugacaggcagcugccaauucugucauauaagaagcagcucugcccaugcaacuuugaaaguuccugcacuucuccauagacugcuccuucauggaaauaaacacaucaucacacugugggugccuaagcuaaguuuguuugcaguuugaugaugcccagcuccuuuucaacucagccuuaauuggcacuuuaagggccaggaugagguuucucucaggccaagucgagauuuccagauuuccuuuuguccaaggcugaccaguuuagaaguuauucacauccuuguuuuaguucuuuccuucuuguccugguaccucuuccuuuccaggauuauuugcagagucugugauggcuuacuuggugaccagacauggggugagcuacugguauagucugauuacuuuggcaucuauucugaacuggucauuggcuguacaugaguuuuugugcugguaaaggaauauacugggaagauuggaaggcacagacugggaacuaauucugagaagagaacugcugaguuacugaaagaccuuuuggaccaccccuaaauggagcaucuugauagauggcaaauccaguguuucuuaaacuuguccaugcugcccagagcccacugccuuuuaucagaugugagacuucacugccacagugucaucccacaguuuccuucccuggacauuugauaaagggaaaaucauuucuuguccuuuaaggcagggacuauuauuuuuucacuuuuccacauaccccacaacaccuaacauugauuuacucguaguaggaguuucauacuguugaacucucuaaaggccauuuguuccagggccuagcugggcuugugaaggacaacagagucauuuccuaaggaccccaaaagacagcaugaaggaaaaaauaauaauaaacugcuguucacagugccuugaguguaccaccguacuuucugcuaugccuuguccauuccaaucuggacagucucugugccccuccuuuccacucaaguguuauccagcacucaaguucuggcucaaggcccaacaucuccguggggaccucagccaucccagggcauugugaccccuuccucuaaguccccggcacacucgcugauugguacccucucauucgacaaagcauaugccauuguggcuuacuugucauuucuuuaggucuugccuucccaaguagaucaugagccacuauaagaacuagcucccauagucccagccccugggccugguacauggcaaugcuuagugauuggugauugaggauaauggugguaaaggauguaccagacagucaucuccugaagagaugccgaacaaccuguccuuguuuuauguauuuucucuuucuuuccuguccaguuuuauuccucucauaguaacugcuaaaaaaauaucaguuccugucacucuuccaccccuuuucucccucuccccugcauuguggucugggccuugguccacuagcaacuccccuuagguguugcuuaaucugccucauggccaaagccaaucccauuccugucccccgcuacccaagggacucccagucuguaugcacaaggcgggaugugaagucuggaugugcaagaaacccagcuguaagaaacagcuucccucggcuuggcaugguggcucaugccuauauucccagcacuuugagaggucaaagugggagaaucacuugagcccaggaguucaggacuagccugggcaacauagcaagaucccaccucuacaaaaaaagaaaaaauucagagucucaaaugucccuucaucuccuuacucucgaccugucucccuaguucucugccgccuuuuccucuccccuggaucugacacucaauugucugcaugcacuuuucaacugaaagagacuccaaugccauccuucugaugaaauuuuugcuuuggauacuacugcagaaaaaaugcuaucuuguauucugguccaugguggggaagacccugucguagaaccuggcaacucaaguggagggaggggccagaacauuguucuuaugcuauuuacagugagacaacaggauugaugcagaacuuucuuuuuuuuuuuuuuuuuuugagacagaguuucauucuuguugcccagggcuggagugcaguggcaugaucucagcucacugcaaccuccaccccccagguucaagcaguucuuccucagccuccggaguagcugggauuacaggcgugcgccaccacgccccacuaauuuuuguauuuuugguagagacgggguuucaccaguguuggccaggcuggucucgaacuccugaccucaggugauccacccaccucggccucccaaagugcugggauuacaggcaugaaccaccgugcccggccgugaugcgcaacuuucuaauaacauacuuuugaaagugcccagacauacaucccuccucugguaccacaguggccaucaguugccagagaacaugaaauuauccagcccucagcucugcagcaggauucugaggaguaaagcaggccuguaaaguacucuaaaguacuucagagagguaaugccacaaagcgaagaacaccucuuggaggcagagccccucagcccuauccaggccagcaguguccacuugaaaucugaaagcagccucccucaccaaaccagcaagauggaaaaccucccuggguuggcaaguggcccugggaaguacaugccccaucucugucaggauagcaguggagagguuucgugccagugccagcuccacccacccagaugguacucaagacuccaagccugucaaugggguggaaacuuucuggcauuuucugucagaagggugaguuagcacugaaccaucucaugugucuuuucacugaguaacagcccauauccauuccaugaaaugagugacugcuuuguugaaucagauaguaacaaacauuuauuuguagucugguugugucauaucaugguugaauugcaaacagguuggauagaagagucagcaaaaaucaacaaaagcauucuguaaaaaacuuuucuagaauuacaauaaauggcauuguauauuuuauuuauaaauuaugugcugcacaucauuuuuaucaaugaaauuuauaauaaauuucuguacauauaua

SEQ ID NO: 1472 - RNA, 87 nt, Homo Sapiens
caccugcauucaaaaaugaucacgggcugccugugcucuggucaucaauaacgcagggagaggaauugcugaaagccguuucccgug

SEQ ID NO: 1473 - RNA, 87 nt, Homo Sapiens
ugcacugcaugguaucugcacucagcaguuuacaccugcuaggguguucaaaggucagugcuauagaaauucaguaucuggcaucgu

SEQ ID NO: 1474 - RNA, 87 nt, Homo Sapiens
auccaaggugauuccuucuccaagggggacauccagugacccucucaggaaguagcaacuuggaauagaauaguccaggaguuccag

SEQ ID NO: 1475 - RNA, 87 nt, Homo Sapiens
ccucgcuuucuuugcagggagcagguauguauguucccuauuaugucuggaggcagagggaaaaggcuucaguccccugggcaucau

SEQ ID NO: 1476 - RNA, 87 nt, Homo Sapiens
ugccccugaccugggaagagaggggccuggcuggugguauccaucucauaccagcuagggaugaagaaaccgcuugcucaucccagc

SEQ ID NO: 1477 - RNA, 81 nt, Homo Sapiens
auccuuuuguaguucaggugcaugugugaguugugccucccucaaaccuuguuacaaagucagcacauuaccugucuauca

SEQ ID NO: 1478 - RNA, 87 nt, Homo Sapiens
auccuucuguggcugauaugugugaugaggggguuuucacacucuugcgugggacgugcaaccucuuuagaacaguggcacauuacc

SEQ ID NO: 1479 - RNA, 87 nt, Homo Sapiens
auccuucuguggcugauaugugugaugaggggguuuucacacucuugcgugggacgugaaacgucuuuagaacaguggcacguuacc

SEQ ID NO: 1480 - RNA, 87 nt, Homo Sapiens
ugagaugagaucaugccauugcacuccagccuggacgacagagcgagacuucaucucaaaaaaaaaaaaggauccucagggcugcca

SEQ ID NO: 1481 - RNA, 87 nt, Homo Sapiens; identical to SEQ ID NO: 1479

SEQ ID NO: 1482 - RNA, 73 nt, Homo Sapiens
uugcaaugaugugaaucucucacugaauucaaccuugaagugcgaauccaugagcuuuuuaacccugagcaau

SEQ ID NO: 1483 - RNA, 87 nt, Homo Sapiens
uggugcugugaugaugccuuaauauugugguuucgacucacugagaguaaaaugaggaccuacaauuccuuggcugugucugagcac

SEQ ID NO: 1484 - RNA, 67 nt, Homo Sapiens
ggaucgaugaugagaauaauugucugaggaugcugagggacucauuccagaugucaaucugaggucc

SEQ ID NO: 1485 - RNA, 67 nt, Homo Sapiens; identical to SEQ ID NO: 1484

SEQ ID NO: 1486 - RNA, 75 nt, Homo Sapiens
uugcagugaugacuugcgaaucaaaucugucaauccccugagugcaaucacugaugucuccaugucucugagcaa

SEQ ID NO: 1487 - RNA, 87 nt, Homo Sapiens
uggaucgaugaugacuauaaaaaaaauggaucucaucggaaucugaacaaaaugagugaccaaaucauuucugugccacuucuguga

SEQ ID NO: 1488 - RNA, 22 nt, Homo Sapiens
cuauacaaccuacugccuuccc

SEQ ID NO: 1489 - RNA, 22 nt, Homo Sapiens
cuauacgaccugcugccuuucu

SEQ ID NO: 1490 - RNA, 21 nt, Homo Sapiens
uacaguacugugauaacugaa

SEQ ID NO: 1491 - RNA, 23 nt, Homo Sapiens
agcuucuuuacagugcugccuug

SEQ ID NO: 1492 - RNA, 21 nt, Homo Sapiens
ggacccacccggccgggaaua

SEQ ID NO: 1493 - RNA, 22 nt, Homo Sapiens
auauacagggggagacucucau

SEQ ID NO: 1494 - RNA, 19 nt, Homo Sapiens
gugaggacucgggaggugg

SEQ ID NO: 1495 - RNA, 20 nt, Homo Sapiens
cgugccacccuuuuccccag

SEQ ID NO: 1496 - RNA, 23 nt, Homo Sapiens
cucucaccacugcccucccacag

SEQ ID NO: 1497 - RNA, 20 nt, Homo Sapiens
ugagcccuguccucccgcag

SEQ ID NO: 1498 - RNA, 20 nt, Homo Sapiens
cuuccucgucugucugcccc

SEQ ID NO: 1499 - RNA, 24 nt, Homo Sapiens
ccccgggaacgucgagacuggagc

SEQ ID NO: 1500 - RNA, 22 nt, Homo Sapiens
ucccugagacccuaacuuguga

SEQ ID NO: 1501 - RNA, 22 nt, Homo Sapiens
ucguaccgugaguaauaaugcg

SEQ ID NO: 1502 - RNA, 25 nt, Homo Sapiens
gggcgacaaagcaagacucuuucuu

SEQ ID NO: 1503 - RNA, 19 nt, Homo Sapiens
ggagauggagguugcagug

SEQ ID NO: 1504 - RNA, 21 nt, Homo Sapiens
accacugcacuccagccugag

SEQ ID NO: 1505 - RNA, 22 nt, Homo Sapiens
ucggauccgucugagcuuggcu

SEQ ID NO: 1506 - RNA, 22 nt, Homo Sapiens
ucuauacagacccuggcuuuuc

SEQ ID NO: 1507 - RNA, 21 nt, Homo Sapiens
cuuuuugcggucugggcuugc

SEQ ID NO: 1508 - RNA, 22 nt, Homo Sapiens
uuuagagacggggucuugcucu

SEQ ID NO: 1509 - RNA, 22 nt, Homo Sapiens
ccaccuccccugcaaacgucca

SEQ ID NO: 1510 - RNA, 22 nt, Homo Sapiens
uuugguccccuucaaccagcug

SEQ ID NO: 1511 - RNA, 22 nt, Homo Sapiens
uuugguccccuucaaccagcua

SEQ ID NO: 1512 - RNA, 22 nt, Homo Sapiens
ugugacugguugaccagagggg

SEQ ID NO: 1513 - RNA, 21 nt, Homo Sapiens
ugagaugaagcacuguagcuc

SEQ ID NO: 1514 - RNA, 22 nt, Homo Sapiens
ggauaucaucauauacuguaag

SEQ ID NO: 1515 - RNA, 22 nt, Homo Sapiens
ugagaacugaauuccauaggcu

SEQ ID NO: 1516 - RNA, 22 nt, Homo Sapiens
aaaguucugagacacuccgacu

SEQ ID NO: 1517 - RNA, 22 nt, Homo Sapiens
uagguuauccguguugccuucg

SEQ ID NO: 1518 - RNA, 22 nt, Homo Sapiens
ccaauauuacugugcugcuuua

SEQ ID NO: 1519 - RNA, 23 nt, Homo Sapiens
aacauucauuguugucggugggu

SEQ ID NO: 1520 - RNA, 23 nt, Homo Sapiens
uaaggugcaucuagugcagauag

SEQ ID NO: 1521 - RNA, 23 nt, Homo Sapiens
uaaggugcaucuagugcaguuag

SEQ ID NO: 1522 - RNA, 22 nt, Homo Sapiens
uagguaguuucauguuguuggg

SEQ ID NO: 1523 - RNA, 22 nt, Homo Sapiens
uagguaguuuccuguuguuggg

SEQ ID NO: 1524 - RNA, 19 nt, Homo Sapiens
accgugcaaagguagcaua

SEQ ID NO: 1525 - RNA, 23 nt, Homo Sapiens
cggguagagagggcagugggagg

SEQ ID NO: 1526 - RNA, 20 nt, Homo Sapiens
ccuccugcccuccuugcugu

SEQ ID NO: 1527 - RNA, 23 nt, Homo Sapiens
ugugcaaauccaugcaaaacuga

SEQ ID NO: 1528 - RNA, 20 nt, Homo Sapiens
agagguauagggcaugggaa

SEQ ID NO: 1529 - RNA, 23 nt, Homo Sapiens
uaaagugcuuauagugcagguag

SEQ ID NO: 1530 - RNA, 22 nt, Homo Sapiens
agaguugagucuggacgucccg

SEQ ID NO: 1531 - RNA, 21 nt, Homo Sapiens
aggcggagacuugggcaauug

SEQ ID NO: 1532 - RNA, 22 nt, Homo Sapiens
uagcaccaucugaaaucgguua

SEQ ID NO: 1533 - RNA, 24 nt, Homo Sapiens
gcugguuucauauggugguuuaga

SEQ ID NO: 1534 - RNA, 23 nt, Homo Sapiens
uagcaccauuugaaaucaguguu

SEQ ID NO: 1535 - RNA, 22 nt, Homo Sapiens
uagcaccauuugaaaucgguua

SEQ ID NO: 1536 - RNA, 22 nt, Homo Sapiens
ugaccgauuucuccugguguuc

SEQ ID NO: 1537 - RNA, 23 nt, Homo Sapiens
ucaacaaaaucacugaugcugga

SEQ ID NO: 1538 - RNA, 21 nt, Homo Sapiens
guuccugcugaacugagccag

SEQ ID NO: 1539 - RNA, 21 nt, Homo Sapiens
auaggacucauauagugccag

SEQ ID NO: 1540 - RNA, 21 nt, Homo Sapiens
cacagcaaguguagacaggca

SEQ ID NO: 1541 - RNA, 23 nt, Homo Sapiens
ucgaggacugguggaagggccuu

SEQ ID NO: 1542 - RNA, 22 nt, Homo Sapiens
aaagaucuggaagugggagaca

SEQ ID NO: 1543 - RNA, 21 nt, Homo Sapiens
aggcaagaugcuggcauagcu

SEQ ID NO: 1544 - RNA, 19 nt, Homo Sapiens
acuggccugggacuaccgg

SEQ ID NO: 1545 - RNA, 23 nt, Homo Sapiens
agaagaaggcggucggucugcgg

SEQ ID NO: 1546 - RNA, 21 nt, Homo Sapiens
cacauuacacggucgaccucu

SEQ ID NO: 1547 - RNA, 22 nt, Homo Sapiens
cccaauacacggucgaccucuu

SEQ ID NO: 1548 - RNA, 22 nt, Homo Sapiens
aacacaccugguuaaccucuuu

SEQ ID NO: 1549 - RNA, 23 nt, Homo Sapiens
ucaagagcaauaacgaaaaaugu

SEQ ID NO: 1550 - RNA, 23 nt, Homo Sapiens
ugaggauggauagcaaggaagcc

SEQ ID NO: 1551 - RNA, 24 nt, Homo Sapiens
acaaaaaaaaaagcccaacccuuc

SEQ ID NO: 1552 - RNA, 22 nt, Homo Sapiens
uguuguacuuuuuuuuuuguuc

SEQ ID NO: 1553 - RNA, 87 nt, Homo Sapiens
ucccuggggaccccuggcagccccuccugaugauucuucuuccugagcacgcucaugaugagcaaacugagccucuaagaaguugac

SEQ ID NO: 1554 - RNA, 22 nt, Homo Sapiens
accuuccucuccaugggucuuu

SEQ ID NO: 1555 - RNA, 22 nt, Homo Sapiens
aaagacccauugaggagaaggu

SEQ ID NO: 1556 - RNA, 78 nt, Homo Sapiens
ccugggaggugugauaucaugguuccugggaggugugauccugugcuuccugggaggugugauaucgugguuccuggg

SEQ ID NO: 1557 - RNA, 22 nt, Homo Sapiens
ugugauaucgugcuuccuggga

SEQ ID NO: 1558 - RNA, 23 nt, Homo Sapiens
accuggacccagcguagacaaag

SEQ ID NO: 1559 - RNA, 22 nt, Homo Sapiens
acucaaaagauggcggcacuuu

SEQ ID NO: 1560 - RNA, 22 nt, Homo Sapiens
uuauaauacaaccugauaagug

SEQ ID NO: 1561 - RNA, 22 nt, Homo Sapiens
auauaauacaaccugcuaagug

SEQ ID NO: 1562 - RNA, 21 nt, Homo Sapiens
aucauagaggaaaauccacgu

SEQ ID NO: 1563 - RNA, 21 nt, Homo Sapiens
aacauagaggaaauuccacgu

SEQ ID NO: 1564 - RNA, 21 nt, Homo Sapiens
acuggacuuggugucagaugg

SEQ ID NO: 1565 - RNA, 21 nt, Homo Sapiens
ugguagacuauggaacguagg

SEQ ID NO: 1566 - RNA, 20 nt, Homo Sapiens
gcucggacugagcagguggg

SEQ ID NO: 1567 - RNA, 23 nt, Homo Sapiens
ucucugaguaccauaugccuugu

SEQ ID NO: 1568 - RNA, 22 nt, Homo Sapiens
ucagguguggaaacugaggcag

SEQ ID NO: 1569 - RNA, 22 nt, Homo Sapiens
uguagauacgagcaccagccac

SEQ ID NO: 1570 - RNA, 23 nt, Homo Sapiens
acaggcggcuguagcaauggggg

SEQ ID NO: 1571 - RNA, 22 nt, Homo Sapiens
gaauguugcucggugaaccccu

SEQ ID NO: 1572 - RNA, 23 nt, Homo Sapiens
agguuacccgagcaacuuugcau

SEQ ID NO: 1573 - RNA, 22 nt, Homo Sapiens
uauguaacacgguccacuaacc

SEQ ID NO: 1574 - RNA, 19 nt, Homo Sapiens
gggggaagaaaaggugggg

SEQ ID NO: 1575 - RNA, 18 nt, Homo Sapiens
gggcucacaucaccccau

SEQ ID NO: 1576 - RNA, 21 nt, Homo Sapiens
ugucuugcaggccgucaugca

SEQ ID NO: 1577 - RNA, 23 nt, Homo Sapiens
ucuuggaguaggucauugggugg

SEQ ID NO: 1578 - RNA, 22 nt, Homo Sapiens
aucaugaugggcuccucggugu

SEQ ID NO: 1579 - RNA, 22 nt, Homo Sapiens
auggccagagcucacacagagg

SEQ ID NO: 1580 - RNA, 22 nt, Homo Sapiens
ugucguggggcuugcuggcuug

SEQ ID NO: 1581 - RNA, 17 nt, Homo Sapiens
gccggacaagagggagg

SEQ ID NO: 1582 - RNA, 20 nt, Homo Sapiens
uaacggccgcgguacccuaa

SEQ ID NO: 1583 - RNA, 22 nt, Homo Sapiens
gaagaacuguugcauuugcccu

SEQ ID NO: 1584 - RNA, 75 nt, Homo Sapiens
gucagaggggggaugugcaugcugguuggggugggcugccuguggaccaaucagcgugcacuuccccacccugaa

SEQ ID NO: 1585 - RNA, 23 nt, Homo Sapiens
agggaaaaaaaaaaggauuuguc

SEQ ID NO: 1586 - RNA, 22 nt, Homo Sapiens
uccaggcaggagccggacugga

SEQ ID NO: 1587 - RNA, 22 nt, Homo Sapiens
uguugcaagucgguggagacgu

SEQ ID NO: 1588 - RNA, 22 nt, Homo Sapiens
ucucccuuccugcccuggcuag

SEQ ID NO: 1589 - RNA, 22 nt, Homo Sapiens
ugaucucaccgcugccuccuuc

SEQ ID NO: 1590 - RNA, 80 nt, Homo Sapiens
gguuccggagccccggcgcgggcggguucugggguguagacgcugcuggccagcccgccccagccgagguucucggcacc

SEQ ID NO: 1591 - RNA, 67 nt, Homo Sapiens
uuuaggagagagaugccgccuugcuccuugaacaggaggagcaaggcggcaucucucugauacuaaa

SEQ ID NO: 1592 - RNA, 22 nt, Homo Sapiens
ugcugggggccacaugagugug

SEQ ID NO: 1593 - RNA, 25 nt, Homo Sapiens
aagggaggaggagcggaggggcccu

SEQ ID NO: 1594 - RNA, 22 nt, Homo Sapiens
caaggccaaaggaagagaacag

SEQ ID NO: 1595 - RNA, 78 nt, Homo Sapiens
gggauaaaaugcagggaggcgcucacucucugcugccgauucugcaccagagaugguugccuuccuauauuuuguguc

SEQ ID NO: 1596 - RNA, 22 nt, Homo Sapiens
ccagagaugguugccuuccuau

SEQ ID NO: 1597 - RNA, 22 nt, Homo Sapiens
aauguuggaauccucgcuagag

SEQ ID NO: 1598 - RNA, 21 nt, Homo Sapiens
gacagagugccacuuacugaa

SEQ ID NO: 1599 - RNA, 22 nt, Homo Sapiens
gucauacacggcucuccucucu

SEQ ID NO: 1600 - RNA, 22 nt, Homo Sapiens
aaucauacagggacauccaguu

SEQ ID NO: 1601 - RNA, 22 nt, Homo Sapiens
aaucguacagggucauccacuu

SEQ ID NO: 1602 - RNA, 22 nt, Homo Sapiens
ugaaggucuacugugugccagg

SEQ ID NO: 1603 - RNA, 81 nt, Homo Sapiens
gauacucgaaggagagguuguccguguugucuucucuuuauuuaugaugaaacauacacgggaaaccucuuuuuuaguauc

SEQ ID NO: 1604 - RNA, 22 nt, Homo Sapiens
ugaaacauacacgggaaaccuc

SEQ ID NO: 1605 - RNA, 22 nt, Homo Sapiens
aaacaaacauggugcacuucuu

SEQ ID NO: 1606 - RNA, 22 nt, Homo Sapiens
uuuugugucucccauuccccag

SEQ ID NO: 1607 - RNA, 22 nt, Homo Sapiens
cgucaacacuugcugguuuccu

SEQ ID NO: 1608 - RNA, 21 nt, Homo Sapiens
auccaguucucugagggggcu

SEQ ID NO: 1609 - RNA, 22 nt, Homo Sapiens
aaacauucgcggugcacuucuu

SEQ ID NO: 1610 - RNA, 25 nt, Homo Sapiens
aaaaaccacaauuacuuuugcacca

SEQ ID NO: 1611 - RNA, 22 nt, Homo Sapiens
aaaaguaauugugguuuuggcc

SEQ ID NO: 1612 - RNA, 25 nt, Homo Sapiens
aaaaaccacaauuacuuuugcacca

SEQ ID NO: 1613 - RNA, 20 nt, Homo Sapiens
guccgcucggcgguggccca

SEQ ID NO: 1614 - RNA, 22 nt, Homo Sapiens
ucaguuccaggccaaccaggcu

SEQ ID NO: 1615 - RNA, 21 nt, Homo Sapiens
ccugcgagucuccggcggugg

SEQ ID NO: 1616 - RNA, 19 nt, Homo Sapiens
ugaggugguaggauguaga

SEQ ID NO: 1617 - RNA, 19 nt, Homo Sapiens
cagcaggaggugaggggag

SEQ ID NO: 1618 - RNA, 21 nt, Homo Sapiens
agggggaaaguucuauagucc

SEQ ID NO: 1619 - RNA, 87 nt, Homo Sapiens
gugagcgggcgcggcagggaucgcgggcggguggcggccuagggcgcggagggcggaccgggaauggcgcgccgugcgccgccggcg

SEQ ID NO: 1620 - RNA, 67 nt, Homo Sapiens
ccugcaggcagaaguggggcugacagggcagaggguugcgcccccucaccaucccuucugccugcag

SEQ ID NO: 1621 - RNA, 67 nt, Homo Sapiens; identical to SEQ ID NO: 1620

SEQ ID NO: 1622 - RNA, 67 nt, Homo Sapiens; identical to SEQ ID NO: 1620

SEQ ID NO: 1623 - RNA, 67 nt, Homo Sapiens; identical to SEQ ID NO: 1620

SEQ ID NO: 1624 - RNA, 85 nt, Homo Sapiens
gggacggggccugcaggcagaaguggggcugacagggcagaggguugcgcccccucaccaccccuucugccugcagcggugggcu

SEQ ID NO: 1625 - RNA, 71 nt, Homo Sapiens
ggggccugcaggcagaaguggggcugacagggcagaggguugcgcccccucaccaccccuucugccugcag

SEQ ID NO: 1626 - RNA, 21 nt, Homo Sapiens
cugccuguucuuccacuccag

SEQ ID NO: 1627 - RNA, 22 nt, Homo Sapiens
uaugucugcugaccaucaccuu

SEQ ID NO: 1628 - RNA, 20 nt, Homo Sapiens
cucgcccugucucccgcuag

SEQ ID NO: 1629 - RNA, 21 nt, Homo Sapiens
uugggguggucggcccuggag

SEQ ID NO: 1630 - RNA, 20 nt, Homo Sapiens
accuggguuguccccucuag

SEQ ID NO: 1631 - RNA, 22 nt, Homo Sapiens
cagccgccgccugucuccacag

SEQ ID NO: 1632 - RNA, 21 nt, Homo Sapiens
cuccuccccugccuggcccag

SEQ ID NO: 1633 - RNA, 22 nt, Homo Sapiens
ucuucaccugccucugccugca

SEQ ID NO: 1634 - RNA, 60 nt, Homo Sapiens
uauccugagaaggcacagcuugcacgugaccuccugggccuggcggcugugucuucacag

SEQ ID NO: 1635 - RNA, 60 nt, Homo Sapiens; identical to SEQ ID NO: 1634

SEQ ID NO: 1636 - RNA, 60 nt, Homo Sapiens; identical to SEQ ID NO: 1634

SEQ ID NO: 1637 - RNA, 24 nt, Homo Sapiens
ugagaaggcacagcuugcacguga

SEQ ID NO: 1638 - RNA, 22 nt, Homo Sapiens
uggguguaggcuggagcugagg

SEQ ID NO: 1639 - RNA, 21 nt, Homo Sapiens
aggcccuguccucugccccag

SEQ ID NO: 1640 - RNA, 20 nt, Homo Sapiens
uccacucuccuggcccccag

SEQ ID NO: 1641 - RNA, 22 nt, Homo Sapiens
ucccucgccuucucacccucag

SEQ ID NO: 1642 - RNA, 25 nt, Homo Sapiens
auggggugagauggggaggagcagc

SEQ ID NO: 1643 - RNA, 22 nt, Homo Sapiens
uugugugaguacagagagcauc

SEQ ID NO: 1644 - RNA, 61 nt, Homo Sapiens
gaggguugggguggagggccaaggagcuggguggggugccaagccucuguccccaccccag

SEQ ID NO: 1645 - RNA, 22 nt, Homo Sapiens
ugugacuucuccccugccacag

SEQ ID NO: 1646 - RNA, 21 nt, Homo Sapiens
ucucuggucuugccaccccag

SEQ ID NO: 1647 - RNA, 22 nt, Homo Sapiens
cgcagggcccuggcgcaggcau

SEQ ID NO: 1648 - RNA, 22 nt, Homo Sapiens
gcccaggacuuugugcggggug

SEQ ID NO: 1649 - RNA, 22 nt, Homo Sapiens
agacugaccuucaaccccacag

SEQ ID NO: 1650 - RNA, 67 nt, Homo Sapiens
gugaggaggggcuggcagggaccccuccaaguuggggacggcagccagccccugcucaccccucgcc

SEQ ID NO: 1651 - RNA, 22 nt, Homo Sapiens
caugggaguucggggugguugc

SEQ ID NO: 1652 - RNA, 21 nt, Homo Sapiens
ugucacccgcuccuugcccag

SEQ ID NO: 1653 - RNA, 22 nt, Homo Sapiens
agaggcugagaaggugauguug

SEQ ID NO: 1654 - RNA, 76 nt, Homo Sapiens
acugacuuugagucucuccucagggugcugcaggcaaagcuggggacccagggagagacguaagugaggggagaug

SEQ ID NO: 1655 - RNA, 21 nt, Homo Sapiens
ucuguggaguggggugccugu

SEQ ID NO: 1656 - RNA, 23 nt, Homo Sapiens
uggaagacuagugauuuuguugu

SEQ ID NO: 1657 - RNA, 19 nt, Homo Sapiens
uugaucucggaagcuaagc

SEQ ID NO: 1658 - RNA, 22 nt, Homo Sapiens
acuccagccccacagccucagc

SEQ ID NO: 1659 - RNA, 22 nt, Homo Sapiens
ugagaccucuggguucugagcu

SEQ ID NO: 1660 - RNA, 22 nt, Homo Sapiens
aaaacuaggacuguguggugua

SEQ ID NO: 1661 - RNA, 21 nt, Homo Sapiens
ugaggugaccgcagaugggaa

SEQ ID NO: 1662 - RNA, 18 nt, Homo Sapiens
auccuagucacggcacca

SEQ ID NO: 1663 - RNA, 22 nt, Homo Sapiens
ucaaaaucaggagucggggcuu

SEQ ID NO: 1664 - RNA, 20 nt, Homo Sapiens
guagaggagauggcgcaggg

SEQ ID NO: 1665 - RNA, 22 nt, Homo Sapiens
ugagguaguaaguuguauuguu

SEQ ID NO: 1666 - RNA, 73 nt, Homo Sapiens
guucagaugaugaauuuaacuguucaacugcugaaugauaacgggcaugaacuaaaacuuaauucugacagag

SEQ ID NO: 1667 - RNA, 87 nt, Homo Sapiens
agaggcuugggccgccgagcuggacccggaccgguuuuggguacuguacugggggcagggcagagaggugggcggcaguuggggugc

SEQ ID NO: 1668 - RNA, 82 nt, Homo Sapiens
gcuggauuaaugaugagauauaaccuugacugaagcugaugaugaguuuguauaauuaagcaggauuacucugagauccagc

SEQ ID NO: 1669 - RNA, 87 nt, Homo Sapiens
accccuggcagccccuccugaugauucuucuuccugagcacgcucaugaugagcaaacugagccucuaagaaguugacugaaggggc

SEQ ID NO: 1670 - RNA, 80 nt, Homo Sapiens
gcugagcugaggaugauuuaaaguuaucccugucugaaaugguaucuuuugugaggaggucugacuugcugaggcucagc

SEQ ID NO: 1671 - RNA, 67 nt, Homo Sapiens
uuccuaugaugaggaccuuuucacagaccuguacugagcuccgugaggauaaauaacucugaggaga

SEQ ID NO: 1672 - RNA, 75 nt, Homo Sapiens
gucagaugauuugaauugauaagcugauguucugugagguacaaaaguuaauagcauguuagaguucugauggca

SEQ ID NO: 1673 - RNA, 65 nt, Homo Sapiens
uuucuaugaugaaucaaacuagcucacuaugaccgacagugaaaauacaugaacaccugagaaac

SEQ ID NO: 1674 - RNA, 83 nt, Homo Sapiens
ggccggugaugagaacuucucccacucacauucgaguuucccgaccaugagaugacuccacaugcacuaccaucugaggccac

SEQ ID NO: 1675 - RNA, 86 nt, Homo Sapiens
ggcagaugauguccuuaucucacgauggucugcggaugucccugugggaauggcgacaaugccaauggcuuagcugaugccaggag

SEQ ID NO: 1676 - RNA, 72 nt, Homo Sapiens
uugcaaugaugugaaucucucacugaauucaaccuugaagugcgaauccaugagcuuuuuaacccugagcaa

SEQ ID NO: 1677 - RNA, 69 nt, Homo Sapiens
ucucagugaugaaaacuuuguccaguucugcuacugacaguaagugaagauaaagugugucugaggaga

SEQ ID NO: 1678 - RNA, 71 nt, Homo Sapiens
ccacaaugauggcaauauuuuucgucaacagcaguucaccuagugaguguugagacucugggucugaguga

SEQ ID NO: 1679 - RNA, 71 nt, Homo Sapiens; identical to SEQ ID NO: 1678

SEQ ID NO: 1680 - RNA, 75 nt, Homo Sapiens; identical to SEQ ID NO: 736

SEQ ID NO: 1681 - RNA, 87 nt, Homo Sapiens
acucucucggcucugcauaguugcacuuggcuucacccgugugacuuucguaacggggagagagagaaaagaucuccucaggaccuc

SEQ ID NO: 1682 - RNA, 85 nt, Homo Sapiens
uacuguuagugaugauuuuaaaauuaaagcagaugggaaucucucugagaaagaaaauggagauuaaucuuaaacugaaacagua

SEQ ID NO: 1683 - RNA, 83 nt, Homo Sapiens
uggccgaugaugacgagaccacugcgcaaucugaguucugggaaccaggugauggaguauguucugagaacagacugaggccg

SEQ ID NO: 1684 - RNA, 87 nt, Homo Sapiens
ccuccuuuucuuggcggggaucgggcuuguggugccgcuccccguaauguacggaggaagagggaaagggcucuggcccccucggcg

SEQ ID NO: 1685 - protein, 330 aa, Homo Sapiens
ASFKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1686 - protein, 326 aa, Homo Sapiens
ASFKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTWVVVDVSHEDPEVQFNWYVDGVEVHNAKTKPREEQFNSTFCVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1687 - protein, 377 aa, Homo Sapiens
ASFKGPSVFPLAPCSRSTPGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCPVKGFYPSDIAVEWESSGQPENNYNTTPPMLDSDGSFFLYSKLTVDKSRWQQGNIFSCSVMHEALHNRFTQKSLSLSPGK

SEQ ID NO: 1688 - protein, 327 aa, Homo Sapiens
ASFKGPSVFPLVPCSRSTSESTAALGCLVKDYFPEPVTVSWNSCALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVRVLTVLHQDWLNGKEYKCKVSNKGLPSSIEKTISKAKGQPREPQVYTLPPSQEEMTKNQVSLTCLVKGFYPSDIAVEWESNGQPEDNYKTTPPVLDSDGSFFLYSRLTVDKSRWQEGNVFSCSVMHEALHNHYTQKSLSLSPGK

SEQ ID NO: 1689 - protein, 155 aa, Homo Sapiens
NIQMTQSPSSLSASVGDRVTITCRASQTITTYLNWYQQKPGQAPKLLIYTASNLQSGVPSRFSGSGSGTDFTLTISSLQPEDFATYYCQQSYTTYYSFGQGTKLEIKRTVAAPSVFIFPPSDEQLKSGTASVVCLLNNFYPREAKVQWKVDNALQ

SEQ ID NO: 1690 - protein, 147 aa, Homo Sapiens
QSALTQPPSASGSPGQSVTISCTGTSSDVGAYNYVSWYQQHPGKAPKLMIYEVNKRPSGVPDRFSGSKSGNTASLTVSGLQAEDEADYYCSSHTSSGTYVFGTGTKVTVLGQPKANPTVTLFPPSSEELQANKATLVCLISDFYPGA

SEQ ID NO: 1691 - protein, 267 aa, Homo Sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 1692 - protein, 752 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1693 - protein, 806 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 1694 - protein, 810 aa, Homo Sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1695 - protein, 498 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 1696 - protein, 683 aa, Homo Sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTVMDVLKGDNRFSMLVAAIQSAGLTETLNREGVYTVFAPTNEAFRALPPRERSRLLGDAKELANILKYHIGDEILVSGGIGALVRLKSLQGDKLEVSLKNNVVSVNKEPVAEPDIMATNGVVHVITNVLQPPANRPQERGDELADSALEIFKQASAFSRASQRSVRLAPVYQKLLERMKH

SEQ ID NO: 1697 - protein, 560 aa, Homo Sapiens
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQARGAALARPPCCVPTAYAGKLLISLSEERISAHHVPNMVATECGCR

SEQ ID NO: 1698 - protein, 138 aa, Homo Sapiens
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 1699 - protein, 2813 aa, Homo Sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 1700 - protein, 233 aa, Homo Sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 1701 - protein, 188 aa, Homo Sapiens
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 1702 - protein, 408 aa, Homo Sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 1703 - protein, 116 aa, Homo Sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 1704 - protein, 622 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 1705 - protein, 290 aa, Homo Sapiens
MGILSFLPVLATESDWADCKSPQPWGHMLLWTAVLFLAPVAGTPAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 1706 - protein, 291 aa, Homo Sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 1707 - protein, 309 aa, Homo Sapiens
MGILSFLPVLATESDWADCKSPQPWGHMLLWTAVLFLAPVAGTPAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 1708 - protein, 750 aa, Homo Sapiens
MSQPGQKPAASPRPRRAAAARRTHEHVSEKTSESPSKPGEKKGSDEKKAASLGSSQSSRTYAGGTASATKVSASSGATSKSSSMNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 1709 - protein, 144 aa, Homo Sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 1710 - protein, 620 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGESCPPVLHQGQPGPDMPRGCDPNNPGGVSGRGLAQPEEAPAAQGQGCAEAASAPPAPPADPEIKRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLRGLRWENGLSLGGRGCSELRSHHCTLARVTKPDFVSKNTGMNMSITLI

SEQ ID NO: 1711 - protein, 480 aa, Homo Sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 1712 - protein, 77 aa, Homo Sapiens
MRAPGCGRLVLPLLLLAAAALAEGDAKGLKEGETPGNFMEDEQWLSSISQYSGKIKHWNRFRDVPSSDPPSTTQATP

SEQ ID NO: 1713 - protein, 442 aa, Homo Sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 1714 - protein, 317 aa, Homo Sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 1715 - protein, 247 aa, Homo Sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1716 - protein, 276 aa, Homo Sapiens
MLCAISLCARVRKLRSAGRCGKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1717 - protein, 329 aa, Homo Sapiens
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1718 - protein, 268 aa, Homo Sapiens
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1719 - protein, 360 aa, Homo Sapiens
MSDSKEPRLQQLGLLVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1720 - protein, 312 aa, Homo Sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1721 - protein, 380 aa, Homo Sapiens
MSDSKEPRLQQLGLLEEEQLRGLGFRQTRGYKSLAVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1722 - protein, 398 aa, Homo Sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1723 - protein, 243 aa, Homo Sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1724 - protein, 620 aa, Homo Sapiens
MGPLMVLFCLLFLYPAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1725 - protein, 403 aa, Homo Sapiens
MQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 1726 - protein, 808 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 1727 - protein, 478 aa, Homo Sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPAVHHPSNWPMRQNWAIPLPLMSYGPWQCRRGGVPTSHPPGAALPQTLMG

SEQ ID NO: 1728 - protein, 478 aa, Homo Sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 1729 - protein, 195 aa, Homo Sapiens
MAQLCGLRRSRAFLALLGSLLLSGVLAADRERSIHENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 1730 - protein, 481 aa, Homo Sapiens
MTSSPRAPPGEQGRGGAEMIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 1731 - protein, 136 aa, Homo Sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPR

SEQ ID NO: 1732 - protein, 334 aa, Homo Sapiens
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDDEVAQLKKSADTLWDIQKDLKDL

SEQ ID NO: 1733 - protein, 538 aa, Homo Sapiens
MRALCIRETCSSELGFSRNWSRRKAGHCPNPGISLGAVRTGFRFGHGDKVRYRCSSNLVLTGSSERECQGNGVWSGTEPICRQPYSYDFPEDVAPALGTSFSHMLGATNPTQKTKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1734 - protein, 695 aa, Homo Sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 1735 - protein, 303 aa, Homo Sapiens
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 1736 - protein, 108 aa, Homo Sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 1737 - protein, 184 aa, Homo Sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1738 - protein, 261 aa, Homo Sapiens
MHMRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 1739 - protein, 240 aa, Homo Sapiens
MGPAGEVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 1740 - protein, 958 aa, Homo Sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKMLEGSMFVKSHHHSLISSTQGHKHCGRPQGPLHRKTRDLCSLVYLLTLPPLLSYDPAKSPSVRNTQE

SEQ ID NO: 1741 - protein, 896 aa, Homo Sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 1742 - protein, 336 aa, Homo Sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 1743 - protein, 343 aa, Homo Sapiens
MTSKGPEEEHPSVTLFRQYLRIRTVQPKPDYGAAVAFFEETARQLGLGCQKVEVAPGYVVTVLTWPGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 1744 - protein, 373 aa, Homo Sapiens
MTSKGPEEEHPSVTLFRQYLRIRTVQPKPDYGTNPTLSSILLNSHTDVVPVFKEHWSHDPFEAFKDSEGYIYARGAQDMKCVSIQYLEAVRRLKVEGHRFPRTIHMTFVPDEEVGGHQGMELFVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 1745 - protein, 521 aa, Homo Sapiens
MKENVASATVFTLLLFLNTCLLNVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 1746 - protein, 349 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQEREQRQAQEARDS

SEQ ID NO: 1747 - protein, 376 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGDPLMLGASHYKNLKSYRPRKISSQGRLAVFTKATLTTVQ

SEQ ID NO: 1748 - protein, 288 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEVTP

SEQ ID NO: 1749 - protein, 268 aa, Homo Sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSGDPLMLGASHYKNLKSYRPRKISSQGRLAVFTKATLTTVQ

SEQ ID NO: 1750 - protein, 312 aa, Homo Sapiens
MHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGGAIGSLGHLLLFTAATASLAL

SEQ ID NO: 1751 - protein, 482 aa, Homo Sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 1752 - protein, 424 aa, Homo Sapiens
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 1753 - protein, 147 aa, Homo Sapiens
MDYYRKYAAIFLVTLSVFLHVLHSAPDVQETGFHHVAQAALKLLSSSNPPTKASQSARITDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 1754 - protein, 321 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 1755 - protein, 134 aa, Homo Sapiens
MVSRDQAHLGPKYVGLWDFKSRTDEELSFRAGDVFHVARKEEQWWWATLLDEAGGAVAQGYVPHNYLAERETVESEPAGHAGCAALQDLAACRGPAAPERGGVLPQPARACELPQGPEPVPRPAAGRALPEARA

SEQ ID NO: 1756 - protein, 93 aa, Homo Sapiens
MLSFLFFPQDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 1757 - protein, 386 aa, Homo Sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 1758 - protein, 506 aa, Homo Sapiens
MGTRSAIAAPRILCSRGLRSGSARATGSGVERSPSAAIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1759 - protein, 723 aa, Homo Sapiens
MAGLLGAFSPTPAPRACTHPQHHGCARAADSGRPQEPPGLCLRRSANVRLPVGFAQAVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 1760 - protein, 328 aa, Homo Sapiens
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRVRNQESACSRGLPVLTISLCLLPLLRTPLTAHLLQEVFSDYTHAM

SEQ ID NO: 1761 - protein, 172 aa, Homo Sapiens
MAQRLGEWARGPSDATGLYRAVLLRSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 1762 - protein, 175 aa, Homo Sapiens
MGAAQGKKKTYSPQARFHSENEKQRRNGSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 1763 - protein, 666 aa, Homo Sapiens
MNPTETKAVKTEPEKKSQSTKPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 1764 - protein, 636 aa, Homo Sapiens
MNPTETKAVKTEPEKKSQSTKLSVVHEKKSQEGKPKEHTEPKSLPKQASDTGSNDAHNKKAVSRSAEQQPSEKSTEPKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 1765 - protein, 660 aa, Homo Sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCDR

SEQ ID NO: 1766 - protein, 702 aa, Homo Sapiens
MFVGLFSLLSFNVFRSGDGVAEPRRWQRGSPGAVGLYVDPMEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 1767 - protein, 184 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTK

SEQ ID NO: 1768 - protein, 461 aa, Homo Sapiens
MAQADIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 1769 - protein, 470 aa, Homo Sapiens
MGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 1770 - protein, 137 aa, Homo Sapiens
MAALVEPLGLERDVSRAVELLERLQRSGELPPQKLQALQRVLQSRFCSAIREVYEQLYDTLDITGSAEIRAHATAKSVEGEQHEKAVELLKAAQGSVKLVVRYTPRVLEEMEARFEKMRSARRRQQHQSYSSLESRG

SEQ ID NO: 1771 - protein, 169 aa, Homo Sapiens
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 1772 - protein, 688 aa, Homo Sapiens
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 1773 - protein, 423 aa, Homo Sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 1774 - protein, 142 aa, Homo Sapiens
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 1775 - protein, 1118 aa, Homo Sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 1776 - protein, 206 aa, Homo Sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 1777 - protein, 345 aa, Homo Sapiens
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 1778 - protein, 107 aa, Homo Sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 1779 - protein, 107 aa, Homo Sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 1780 - protein, 547 aa, Homo Sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 1781 - protein, 1165 aa, Homo Sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 1782 - protein, 469 aa, Homo Sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 1783 - protein, 241 aa, Homo Sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 1784 - protein, 456 aa, Homo Sapiens
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 1785 - protein, 483 aa, Homo Sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 1786 - protein, 247 aa, Homo Sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 1787 - protein, 114 aa, Homo Sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 1788 - protein, 414 aa, Homo Sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 1789 - protein, 207 aa, Homo Sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 1790 - protein, 283 aa, Homo Sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 1791 - protein, 310 aa, Homo Sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 1792 - protein, 313 aa, Homo Sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 1793 - protein, 247 aa, Homo Sapiens
MQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 1794 - protein, 97 aa, Homo Sapiens
MVFVRRPWPALTTVLLALLVCLGALVDAYPIKPEAPGEDASPEELNRYYASLRHYLNLVTRQRYGKRDGPDTLLSKTFFPDGEDRPVRSRSEGPDLW

SEQ ID NO: 1795 - protein, 513 aa, Homo Sapiens
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 1796 - protein, 572 aa, Homo Sapiens
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 1797 - protein, 421 aa, Homo Sapiens
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 1798 - protein, 196 aa, Homo Sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 1799 - protein, 976 aa, Homo Sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 1800 - protein, 662 aa, Homo Sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 1801 - protein, 451 aa, Homo Sapiens
MVSRDQAHLGPKYVGLWDFKSRTDEELSFRAGDVFHVARKEEQWWWATLLDEAGGAVAQGYVPHNYLAERETVESEPWFFGCISRSEAVRRLQAEGNATGAFLIRVSEKPSADYVLSVRDTQAVRHYKIWRRAGGRLHLNEAVSFLSLPELVNYHRAQSLSHGLRLAAPCRKHEPEPLPHWDDWERPREEFTLCRKLGSGYFGEVFEGLWKDRVQVAIKVISRDNLLHQQMLQSEIQAMKKLRHKHILALYAVVSVGDPVYIITELMAKGSLLELLRDSDEKVLPVSELLDIAWQVAEGMCYLESQNYIHRDLAARNILVGENTLCKVGDFGLARLIKEDVYLSHDHNIPYKWTAPEALSRGHYSTKSDVWSFGILLHEMFSRGQVPYPGMSNHEAFLRVDAGYRMPCPLECPPSVHKLMLTCWCRDPEQRPCFKALRERLSSFTSYENPT

SEQ ID NO: 1802 - protein, 215 aa, Homo Sapiens
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 1803 - protein, 646 aa, Homo Sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 1804 - protein, 322 aa, Homo Sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 1805 - protein, 304 aa, Homo Sapiens
MCGPDDRCPARWPGPGRAVKCGKGLAAARPGRVERGGAQRGGAGLELHPLLGGRTWRAARDADGCEALGTVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 1806 - protein, 424 aa, Homo Sapiens; identical to SEQ ID NO: 1752

SEQ ID NO: 1807 - protein, 339 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 1808 - protein, 686 aa, Homo Sapiens
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 1809 - protein, 176 aa, Homo Sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 1810 - protein, 108 aa, Homo Sapiens; identical to SEQ ID NO: 1736

SEQ ID NO: 1811 - protein, 573 aa, Homo Sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 1812 - protein, 251 aa, Homo Sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 1813 - protein, 252 aa, Homo Sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 1814 - protein, 404 aa, Homo Sapiens
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 1815 - protein, 628 aa, Homo Sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 1816 - protein, 316 aa, Homo Sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 1817 - protein, 207 aa, Homo Sapiens
MAALVEPLGLERDVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 1818 - protein, 694 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 1819 - protein, 315 aa, Homo Sapiens
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 1820 - protein, 113 aa, Homo Sapiens
MKVSVAALSCLMLVAVLGSQAQFTNDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 1821 - protein, 452 aa, Homo Sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 1822 - protein, 108 aa, Homo Sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 1823 - protein, 734 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 1824 - protein, 184 aa, Homo Sapiens
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 1825 - protein, 390 aa, Homo Sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 1826 - protein, 381 aa, Homo Sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTDGMISAHCNLRLPDSRDSPASASRVAGITGICHHTRLILYF

SEQ ID NO: 1827 - protein, 255 aa, Homo Sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1828 - protein, 262 aa, Homo Sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 1829 - protein, 686 aa, Homo Sapiens
MNPTETKAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 1830 - RNA, 22 nt, Homo Sapiens
aacccguagauccgaacuugug

SEQ ID NO: 1831 - RNA, 22 nt, Homo Sapiens
uggagugugacaaugguguuug

SEQ ID NO: 1832 - RNA, 22 nt, Homo Sapiens
ugagaacugaauuccauggguu

SEQ ID NO: 1833 - RNA, 22 nt, Homo Sapiens
ucagugcacuacagaacuuugu

SEQ ID NO: 1834 - RNA, 22 nt, Homo Sapiens
uagcuuaucagacugauguuga

SEQ ID NO: 1835 - RNA, 22 nt, Homo Sapiens
uggcucaguucagcaggaacag

SEQ ID NO: 1836 - RNA, 22 nt, Homo Sapiens
cauugcacuugucucggucuga

SEQ ID NO: 1837 - RNA, 22 nt, Homo Sapiens
ugcuaugccaacauauugccau

SEQ ID NO: 1838 - RNA, 6831 nt, Homo Sapiens
ccaggccccauuguucccgguuuccagccauggcugccauuaccugaccagcgccacagccggucucucugcaggcgccgggagaagugaccagagcaauuucugcuuuucacagggcggguuucucaacggugacuugugggcagugccuucugcugagcgagucauggcccgaaggcagaacuaacugugccugcagucuucacucucaggaugcagccgaggugggcccaaggggccacgauguggcuuggaguccugcugacccuucugcucuguucaagccuugagggucaagaaaacucuuucacaaucaacaguguugacaugaagagccugccggacuggacggugcaaaaugggaagaaccugacccugcagugcuucgcggaugucagcaccaccucucacgucaagccucagcaccagaugcuguucuauaaggaugacgugcuguuuuacaacaucuccuccaugaagagcacagagaguuauuuuauuccugaaguccggaucuaugacucagggacauauaaauguacugugauugugaacaacaaagagaaaaccacugcagaguaccagguguugguggaaggagugcccagucccagggugacacuggacaagaaagaggccauccaaggugggaucgugagggucaacuguucugucccagaggaaaaggccccaauacacuucacaauugaaaaacuugaacuaaaugaaaaaauggucaagcugaaaagagagaagaauucucgagaccagaauuuugugauacuggaauuccccguugaggaacaggaccgcguuuuauccuuccgaugucaagcuaggaucauuucugggauccauaugcagaccucagaaucuaccaagagugaacuggucaccgugacggaauccuucucuacacccaaguuccacaucagccccaccggaaugaucauggaaggagcucagcuccacauuaagugcaccauucaagugacucaccuggcccaggaguuuccagaaaucauaauucagaaggacaaggcgauuguggcccacaacagacauggcaacaaggcuguguacucagucauggccaugguggagcacaguggcaacuacacgugcaaaguggaguccagccgcauauccaaggucagcagcaucguggucaacauaacagaacuauuuuccaagcccgaacuggaaucuuccuucacacaucuggaccaaggugaaagacugaaccuguccugcuccaucccaggagcaccuccagccaacuucaccauccagaaggaagauacgauugugucacagacucaagauuucaccaagauagccucaaagucggacagugggacguauaucugcacugcagguauugacaaaguggucaagaaaagcaacacaguccagauagucguaugugaaaugcucucccagcccaggauuucuuaugaugcccaguuugaggucauaaaaggacagaccaucgaaguccguugcgaaucgaucaguggaacuuugccuauuucuuaccaacuuuuaaaaacaaguaaaguuuuggagaauaguaccaagaacucaaaugauccugcgguauucaaagacaaccccacugaagacgucgaauaccaguguguugcagauaauugccauucccaugccaaaauguuaagugagguucugagggugaaggugauagccccgguggaugagguccagauuucuauccugucaaguaaggugguggagucuggagaggacauugugcugcaaugugcugugaaugaaggaucuggucccaucaccuauaaguuuuacagagaaaaagagggcaaacccuucuaucaaaugaccucaaaugccacccaggcauuuuggaccaagcagaaggcuagcaaggaacaggagggagaguauuacugcacagccuucaacagagccaaccacgccuccaguguccccagaagcaaaauacugacagucagagucauucuugccccauggaagaaaggacuuauugcagugguuaucaucggagugaucauugcucucuugaucauugcggccaaauguuauuuucugaggaaagccaaggccaagcagaugccaguggaaauguccaggccagcaguaccacuucugaacuccaacaacgagaaaaugucagaucccaauauggaagcuaacagucauuacggucacaaugacgaugucagaaaccaugcaaugaaaccaauaaaugauaauaaagagccucugaacucagacgugcaguacacggaaguucaaguguccucagcugagucucacaaagaucuaggaaagaaggacacagagacaguguacagugaaguccggaaagcugucccugaugccguggaaagcagauacucuagaacggaaggcucccuugauggaacuuagacagcaaggccagaugcacaucccuggaaggacauccauguuccgagaagaacagauaaucccuguauuucaagaccucugugcacuuauuuaugaaccugcccugcucccacagaacacagcaauuccucaggcuaagcugccgguucuuaaauccauccugcuaaguuaauguuggguagaaagagauacagaggggcuguugaauuucccacauacccuccuuccaccaaguuggaacauccuuggaaauuggaagagcacaagaggagauccagggcaaggccauugggauauucugaaacuugaauauuuuguuuugugcagagauaaagaccuuuuccaugcacccucauacacagaaaccaauuuucuuuuuuauacucaaucauuucuagcgcauggccugguuagaggcugguuuuuucucuuuuccuuugguccuucaaaggcuuguaguuuuggcuaguccuuguucuuuggaaauacacagugcugaccagacagccucccccuguccccucuaugaccucgcccuccacaaaugggaaaaccagacuacuugggagcaccgccugugaaauaccaaccugaagacaccguucauucaggcaacgcacaaaacagaaaaugaagguggaacaagcacagauguucuucaacuguuuuugucuacacucuuucucuuuuccucuaccaugcugaaggcugaaagacaggaagauggugccaucagcaaauauuauucuuaauugaaaacuugaaauguguauguuucuuacuaauuuuuaaaaauguauuccuugccagggcaggcaagguggcucacgccuguaaucccagcacuucaggaggcugaggugggcggaucaccugaggucaggaguuugagaccagccugaugaaacccugucucuacuaaaaauacaagaauuagccgggcgugguggcgcaugccuguaguaucagcuacucaagaggcugaggugagauuaucgcuugaacccaggaaacggagguuguagugagcggagaucgcgccacugcacuccagccugagugacagagugagaauccaucucaaaaaaaacaaaaaacaaaauugcuugcuaaagaaguggucuccugaggucuuaagacauuccugacagugucuugagugggugggagagaggcugcugucauugcgcuguggaauuucacagaugagaaccacgccuagccaaaaucacuuuuccuguuugccucagugacacagcugcagggacccucguggauguuguauuaaauaaauuugaccuuugcucuuugcagaucugugaaauguugucuucugaggggccacaugcaucuauagugcugaggacuccuugggccucugaagucacagagagaaccgagcaggucuauguuuuuguuuuguuguuuugagacggagauucgcucuuguugcccgggcuggacugcagcggcgcaaccucugcucacugcaaccuccgccuccuggguucaagcaguucuccugucucagccucccgaguagcugggauuacaggcacaugucaccacgccuggcuaauuuuuguauuuuuaguagagaugggguuucaccacguuggccaggcugaucucgaaugccugaccuuuggugaucugcccgccuuguccucaugugugcuccacaggccuuuggguugggauugcaggcgugagccaccaugcccagccuagacucuuuugacaauaugaugaaagcuguugguuccuuuccccaacacacacacaccgaguuguaucacgaaaaugucauacaauuuccagguuuucugaguggugggcucagauugaggucaaaggaucagacgaccucuaacgaccuucaugucucuguugaugaucuggggacagccagauccccuguguccagggaguuccuuagucccuugccaccaccagagaagggcaauugccacgggagcugcaaagacccuauuccuacuccuggugccuuacuuaugcagcacgacugaauuuuuuguuuuguuuuguuuuguugagacaggggcuugcucuguugcccaggcuggagugcaguggcacaacaauggcucaccgcagccucgaaccccugggcucaagcgauccucccaucucagcuuccuggguagcugggaccagaggcgugagccgccauagcuggcuaauuuuuaauuuuuuuuuugcagagaugagguuucaccauggugcccaggcuggucucgaacuucugggcucaagugauccucccuccuuggccucgcaaagugcugggauugcaggcaugagccaccgcccccggccuguggagcacacaugaguuuaaaauuacuuucccuucugccuauauuuccgaggaggaaacuucaugcgcagggaucuuucuuaguggauuuaauggcuaaaaggucugucugaauccaggacgcuggcuuuagccuuccucggcagcugccguaaccccggugucuaaaccugaagcaucccaggagcacccacuccaggaguuuucucggccgcggaacucauuaguuagagcgcccucuuguguucucaugugguaaucggucacugaaggacuuaaaaugguccuuagccaacacacaguaaaacuuuucccucuucugaccccaagaggucagccacccauuucaugagcauauacuggucgccccaucagcguucucugauuggcuaacugaacccacuccccgaccuagacucaagacaggcgaagugacgcuuaggucaacauucacucacuaaagcaacgacugucgggcgauuuugucucccgcugguuuuggaauggugucuggagacauuuuugguugucacagcugggugggugugcucccggcaucugguggguagaaaccaagcaugcuccuaaacauccuacaggcacagaaccgucucccacgaccaagcaugaucaagucccaaaugccaauaauggccagguugagaaacucugcacagaagcauccaguuauuugucuguuugcucaacaagcuugugcucaucaugcucuguguuccugacgcugugcuggguguuggcggugggaagauuacaagagucacauggcagcuguccuccuggaagguacaacccaguagagaugcagacuaacagagagccaauuacaaagcagugugacaagcgucaugguggaaaauuaaaagcucaaacaagggcacaugggaggggcuuccaacacagacuuugggggauccaggaaggucuaagaggaaagugggucucaccaaagccuugaccauaggcagaggguaccaguggaaaagguggggugaagaacauugaggacaaaaggaagaagugcaggaaggcccugaggcaagggaguggggggugcccuggagggauggcagcagggcagucugucagacccaaguggccuccagcccuagaagccaauuaguccuccucaaaaagcugucacuguccccuaagaauugcugccaggcucccacuggccugacucagucuuugagagucuuaaggaggaggucucugaaagguacacaccaagaacucuccccagcacagcuguuuuuaagacucuccaccagcgucauuggcguguugggaagaaacccucugccacagaggccagcuucagccuuugccuaacaccgcaagggcaaauggaaagguaaacgggaaggagaugucuccccagcaggcuauuugaggacagucuucccugcagaagaucucaaccugggguccacagaguggaaauguuagaguagggagcuaggcaaacaugagcaggacaggugagggcccccacaggaaugucaggcuaccaucaggugauggucaggugguuguuaaacugucucuguaaaauaauaauugguugcagccagcuccaagcaaggacagucucucaauagauacaaaacacccugaucuggugaucagccgcuucccgauaagaucucaggagcugggcaagcagccuggagcaugcgcaccaagaggcaaaauggcggaauuuaaccaguauaugaccuaccuuccucugggaacgcacgacugguaaggggaaaaaugccucaagugagcaugcgcgcaacuucaguaaucacacugugcaugcgaccccuuccaagugcuggcaggucaccacauacgcggacagccugcugcaagggaagaaucaggggagaugagacguaaaucccagaacuaugccaaauacauaaaaccccaaguuaagggucaggcagggcacuuagaucucucaaguugccugccugacccaaguguaguguacuuccuuuuguuccugcucuaaaacuuuuuaauaaacucucacuccugcucuaaaa
